United States Patent 11,624,072 (CANOLA WITH HIGH OLEIC ACID) - sequence listing, part 7

SEQ ID NO: 38756 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttttcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 38757 - DNA, 434 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacacccaccacagcaccgttcaccagtagcaccattaccattagcaaggccggaaacgtcaccaatgaaaccgtcgatagcagcaccgtaatcagtagcgacagaatcaagtttgagacctcaagaaagcaatcccacctcactgcttcaaacgctccatcccacgctccctctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38758 - DNA, 335 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccaccattcactcagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38759 - DNA, 342 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38760 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagaccccaagaaagcaatcccacctaactgcttcaaacgctccatcccacgctccttctccttttcgccttcatcatctcctcctcggcgcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 38761 - DNA, 414 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaggccgccattgctggagatggccaccacctgctgaggggtcaagccgtgggcctggcacagcaccggcaacagccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38762 - DNA, 333 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgggacaccaccattcactcaccccaagaaaccaatcccacctcactgcttcaaacgctccatcccacgctccttctcctcttcgacatcatcatctcctcctcggctcctccctctaccacctctccacagcctacttccctctcccttacctcgcctgacccctctgctgggcctgccaaggctgcgtcctaacgggcctctgggtcatagcccacgagtgcggccaccacgccttcagcgactac

SEQ ID NO: 38763 - DNA, 357 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtccccacgcgtcccagcaatggcggtggcaagcaggcgctggagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38764 - DNA, 344 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcgaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38765 - DNA, 456 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctatcaatttgttgcaacgaacaggtcactatcagtcaaaataaaatcattatttgtcgattgtcttcatcggatcccaaggccaggaaccgtaaaaaggccgcgttgctggcgtttttccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38766 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 38767 - DNA, 347 bp, Artificial
  Mutation in BnaC.FAD2.b introduced by TALE nuclease pair BnFAD2_T03
ctggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38768 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctcggatcggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38769 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcacttcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38770 - DNA, 336 bp, Artificial
  Mutation in BnaC.FAD2.b introduced by TALE nuclease pair BnFAD2_T03
caggatccatgggagcaggtggaagaatgcaagtgtctcctccctccagctcccccggaaccaacaccctcaaacgcgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38771 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38772 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtccccacgcgtcccagcaatggcggtggcaagcaggcgctggagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 38773 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgtgtcctaacgggcctctgggtcatagcccacgagtgcggccaccacgccttcagcgactac

SEQ ID NO: 38774 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 38775 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccatgacagacctcaagaaagcaatcccacctcactgcttcaaacgctccatcccacgctccttctcctcttcgacatcatcatctcctcctcggctcctccctctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 38776 - DNA, 370 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccgtccagcggctgttgccggtgttgtgcctggcggtgacctcaagaaagcaatcccacctccctgcttcaaacgctccatcccacgctccttctcctcttcgacatcatcatctcctcctcggctcctccctctaccacctctccccagcctccttccctctcccttacctcgcctgacccctctactgggcctgccaaggctgcgtcctaacgggcctctgggtcatagcccacgagtgcggccaccacgccttcagcgactac

SEQ ID NO: 38777 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38778 - DNA, 383 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaacaccatcaacatcgtggctggcgatggccaccacctgtgccaggcccacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactgc

SEQ ID NO: 38779 - DNA, 279 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38780 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38781 - DNA, 458 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaccaccacctgctccggggtcaagccgtgggcctggcacagcaccggcaaacgttggcgtcggcaaacagtggtccggcgcacgcgctctggaggccttgctcacggtggcgggagagttgagagggagacctcaagaaagcaatcccacctcactgcttcaaccgctccatcccacgctccttctccccttcgacatcaccatctcctcctcggctcctccctctcccacctctccacagcctacttccctctcccttacctcgcctggcccctctactgggcctgccaagactgcgtcctaacgggcctctgggtcatagcccacgagtgcggccaccacgccttcagcgactac

SEQ ID NO: 38782 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38783 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 38784 - DNA, 452 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctggcgatggccaccacctgctccggggtcaagccgtgggcctggcacagcaccggcaacagccgctggaccgtctccagcgcctgcttgccaccattattgctggcgatgaaagacctcaagaaagcaatcccacctcactgcttcaaacgctccaccccacgctccttctcctcttcgacaccatcatctcctcctcggctcctccctctcccccctctccacagcctactcccctctcccttccctcgcctgacccctctactgggcctgccaaggctgcgtcctaacgggcctctgggtcatagcccacgagggcggccaccacgccttcagcgactac

SEQ ID NO: 38785 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtcttctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38786 - DNA, 426 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggaagactgagcctttcgttttatctgttgtttgtcggtgaacgctctcctgagtaggacaaatccgccgggagcggatttgaacgttgtgagacctcaagaaagcaatcccacctcactgcttcaaacgcgccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38787 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 38788 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38789 - DNA, 328 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccaccattcactcaagaaagcaatcccacctcactgcttcaaacgctccatcccacgctccttctcctcttcgacatcatcatctcctcctcggctcctccctctaccacctctccacagcctacttccctctcccttaccgcgcctgacccctctactgggcctgccaagggtgcgtcctaaccggcgtctgggtcatagcccacgagtgcggccaccacgccttcagcgactac

SEQ ID NO: 38790 - DNA, 350 bp, Artificial
  Mutation in BnaC.FAD2.b introduced by TALE nuclease pair BnFAD2_T03
caggatccatgggtgcaggtggaagaatgcaagtctatactccctccagctcccccgaaaccaaaaccatcaaaggcggcccctgcgagacaccacccttcactctagaccccaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38791 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatccacgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38792 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcaccatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 38793 - DNA, 318 bp, Artificial
  Mutation in BnaC.FAD2.b introduced by TALE nuclease pair BnFAD2_T03
caggatccatggtgcaggtggaagaatgcaagtctctcctccctccagctcccccggaaccaacaccctcaaacgcgtcccctgcgagacacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38794 - DNA, 386 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggggtcaagccgtgggcctggcacagcaccggcaacagccgctggaccgagacctcaagaaagcaatcccacctcactgcttcaaacgctccatcccacgctccttctcctcttcgacatcatcatctcctcctcgggtcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38795 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccaccgcactgtttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38796 - DNA, 349 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccagggctgcgtcctaaccggcgtctgggtcatagcccacgagtgcggccaccacgccttcagcgactac

SEQ ID NO: 38797 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38798 - DNA, 279 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 38799 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtccactgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38800 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaacctcaaacgcgtcccctgcgagacaccaccattcactctcacctcaagaaagcaatcccacctcactgcttcaaacgctccatcccacgctccctctccccttcgacatcaccatctcctcctcggctcctccctctaccacctctccacagcctacttccctctcccttacctcgcctggcccctctactgggcctgccaaggctgcgtcctaacgggcctctgtgtcatagcccacgagtgcggccaccacgccttcagcgactac

SEQ ID NO: 38801 - DNA, 334 bp, Artificial
  Mutation in BnaC.FAD2.b introduced by TALE nuclease pair BnFAD2_T03
caggatcatgggtgcaggtggaagaatgcaagtgtctcctccctccagctcccccgaaaccaaaaccctcaaacgcgtcccctgcgagacaccacccttcacttgagacctcaagaaagcaatcccacctcactgcttcaaacgctccatccctcgctccttctcctacctcctcttcgacatcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38802 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccatggcggacctcaagaaagcaatcccaccttactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38803 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcaactac

SEQ ID NO: 38804 - DNA, 325 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38805 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38806 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38807 - DNA, 349 bp, Artificial
  Mutation in BnaC.FAD2.b introduced by TALE nuclease pair BnFAD2_T03
caggatccatgggtgcaggtggaagaatgcaagtctctcctccctcaagctcccccgaaaccaaaaccctcaaacgcgtcccctgcgagacaccacccttcactcagacatcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38808 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtaccctgcgagacaccgcccttcacttagaactcaagaaagcaatcccacctcactgcttcaaacgctccatccctcgctccttctcctacctcctcttcgacatcctcgtctcctcctccctctaccacctctccccagcccacttccctctcccttacctcgcctgacccctctactgggcctgccaaggctgcgtcctaacgggcctctgggtcatagcccacgagtgcggccaccacgccttcagcgactac

SEQ ID NO: 38809 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccatcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38810 - DNA, 324 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38811 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38812 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccatctacggggcctgccaaggctgcgtcctaacgggcctctgggtcatagcccacgagtgcggccaccacgccttcagcgactac

SEQ ID NO: 38813 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaagggtgcgtcctaaccggcgtctgggtcatagcccacgagtgcggccaccacgccttcagcgactac

SEQ ID NO: 38814 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38815 - DNA, 373 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactatcaggggataacgcaggaaagaacatgtgagcaaaaggccagcaaatctaccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38816 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctattgggcctgccaaggctgcgtcctaacgggcctctgggtcatagcccacgagtgcggccaccacgccttcagcgactac

SEQ ID NO: 38817 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcattgcccacgagtgcggccaccacgccttcagcgactac

SEQ ID NO: 38818 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 38819 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38820 - DNA, 350 bp, Artificial
  Mutation in BnaC.FAD2.b introduced by TALE nuclease pair BnFAD2_T03
caggatccatgggtgcaggtggaagaatgcaagtggctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38821 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcactcccaccccactgtttcaaacgctcgatccctcgctcgttctcctacctcttcttcgacatcctcgtctcctcctccctctaccacctcgccacaacctacttccctctccccccccaccctctcccctacctcgcctggcccctctactgggcctgccaaggctgcgtcctaacgggcgtctgggtcatagcccacgagtgcggccaccacgccttcagcgactac

SEQ ID NO: 38822 - DNA, 342 bp, Artificial
  Mutation in BnaC.FAD2.b introduced by TALE nuclease pair BnFAD2_T03
caggatccatgggtgcaggtggcagaatgcaagtctctactccctccagctaccccggaaccaacaccctcaaacgcgtcccctgcgagacaccacccttcactctagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38823 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 38824 - DNA, 381 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggagagcgttcaccgacaaacaacagataaaacgaaaggcccagtcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 38825 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38826 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38827 - DNA, 341 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38828 - DNA, 337 bp, Artificial
  Mutation in BnaC.FAD2.b introduced by TALE nuclease pair BnFAD2_T03
caggatccatgggtgcaggtggaagaatgcaagtctctcctccctccagctccccggaaccaaaaccctcaaacgcgtcccctgcgagacaccacccttcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38829 - DNA, 330 bp, Artificial
  Mutation in BnaC.FAD2.b introduced by TALE nuclease pair BnFAD2_T03
caggatccatgggtgcaggtggaagaatgcaagtctctcctcctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38830 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcgcgactac

SEQ ID NO: 38831 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcctttacctcgcctgacccctctactgggcctgccaagggtgcgtcctaaccggcgtctgggtcatagcccacgagtgcggccaccacgccttcagcgactac

SEQ ID NO: 38832 - DNA, 415 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcaactatcgtcttgagtccaacccggtaagacacgacttatcgccactggcagcagccactggtaagacctcaagaaagcaatcccaccgcactgtttcaaacgctcgatccctcgctctttctcctacctcatctgggacatcatcatagcctcctgcttctactacgtcgccaccacttacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 38833 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagaccccaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaacctgcgtctgggacatagcccacgagggcggccaccacgccttcagcgactac

SEQ ID NO: 38834 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtcccctgcgagacaccaccattcacttgacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38835 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccccctactgggcctgccaaggctgcgtcctaacgggcctctgggtcatagcccacgagtgcggccaccacgccttcagcgactac

SEQ ID NO: 38836 - DNA, 325 bp, Artificial
  Mutation in BnaC.FAD2.b introduced by TALE nuclease pair BnFAD2_T03
caggatccatggtgcaggtggaagaatgcaagtctctcctccctccagctcccccggaaccaacaccctcaaacgcgtcccctgcgagacaccaccattctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38837 - DNA, 279 bp, Artificial
  Mutation in BnaC.FAD2.b introduced by TALE nuclease pair BnFAD2_T03
caggatccattggtgcaggtggaagaatgcaagtctctcctccctccagcaatcccacctcactgcttcgaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38838 - DNA, 350 bp, Artificial
  Mutation in BnaC.FAD2.b introduced by TALE nuclease pair BnFAD2_T03
caggatccatgggtgcagggggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38839 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgacctcaagaaagcaatcccacctcactgcttcaaacgctcgatccctcgctccttctcctacctcctcttcgacatcctcgtctcctcctccctctaccacctctccacagcctacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 38840 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctctcctacttcgcctggcctctctactgggcctgccaagggtgcgtcctaacgggcctctgggtcatagcccacgagtgcggccaccacgccttcagcgactac

SEQ ID NO: 38841 - DNA, 265 bp, Artificial
  Mutation in BnaC.FAD2.b introduced by TALE nuclease pair BnFAD2_T03
caggatccatgggtgcaggtggaagaatgcaagtctctcctccctccagtctctccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38842 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 38843 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacctcaagaaagcaatcccacctcactgcttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38844 - DNA, 325 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38845 - DNA, 338 bp, Artificial
  Mutation in BnaC.FAD2.b introduced by TALE nuclease pair BnFAD2_T03
caggatccatggggtgcaggtggaagaatgcaagtgtctcctccctccaagaagtctgaaaccgacaacatcaagcgcgtaccctgcgagacaccgcccttcactgtcggaactcaagaaagcaatcccacctcactgcttcaaacgctccatccctcgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 38846 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgtccacgaatgcggccaccacgccttcagcgactac

SEQ ID NO: 38847 - DNA, 363 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcggcgggtgtggtggttacgcgcaaagacctcaagaaagcaatcccacctcactgcttaaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38848 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 38849 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38850 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccccgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgagtgcggccaccacgccttcagcgactac

SEQ ID NO: 38851 - DNA, 337 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcacttggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38852 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcggagacctcaagaaagcaatcccacctcactgcttcaaacgctccatcccacgctccttctcctcttcgacatcctcgtctactcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 38853 - DNA, 312 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgcttcaaacgctccatccctcgctccttctcctacctcatctgggacatcatcatctcctcctcggctcctccctctaccacctctccacagcctacttccctctcccttacctcgcctgacccctctacttggcctgccaaggctgcgtcctaacgggcctctgggtcatagcccacgagtgcggccaccacgccttcagcgactac

SEQ ID NO: 38854 - DNA, 427 bp, Artificial
  Mutation in BnaC.FAD2.b introduced by TALE nuclease pair BnFAD2_T03
caggatccatgggtgcaggtggaagaatgcaagtctctcctccctccagctcctccggaaccaacaccctcaaacgcgtcccctgcgagacaccaccattcactcacagcaccggcaacagccgctggacagcctccagcgcctgcttgtcaccgccaagccgtggccctgacacagcaccggcaacagccgctggacgaccccaagaaagcaatcccaccgcactgctccaaacgctccatcccacgctccttctccccttcgacaccaccatctcctcctcggctcctccctctcccacctccccccagcctccttccctctcccttacctcgcctgacccctctactgggcctgccaaggctgcgtcctaacgggcctctgggtcatagcccacgagtgcggccaccacgccttcagcgactac

SEQ ID NO: 38855 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaacctcaaacgcgtcccctgcgagacaccaccattcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38856 - DNA, 335 bp, Artificial
  Mutation in BnaC.FAD2.b introduced by TALE nuclease pair BnFAD2_T03
caggatccatgggtgcaggtggaagaatgcaagtctctcctctctccagctcccccgaaaccaaaaccctcaaacgcgtcccctgcgagccaccacccttcactctagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38857 - DNA, 346 bp, Artificial
  Mutation in BnaC.FAD2.b introduced by TALE nuclease pair BnFAD2_T03
caggatccatgggtgcaggtggaagaatgcaagtccctcctccctccagctcccccgaaaccaaaaccctcaaacgcgtcccctgcgagacaccacccttcactccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38858 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 38859 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 38860 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttatcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38861 - DNA, 387 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgcgttatcccctgattctgtggataaccgtattaccgagacctcaagaaagcaatcccacctcactgcttcaaacgctccatccctcgctccttctcctacctccccttcgacatcctcgtctcctcctccctctaccacctctccacagcctacttccctctcctcccccaccctctcccttacctcgcctggcccctctactgggcctgccaaggctgcgtcctaacgggcctctgggtcatcacccacgaatgcggccaccacgccttcagcgactac

SEQ ID NO: 38862 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcttctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38863 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaacctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgccccctctacggggcctgccagggctgcgtcctaacgggcctttgggtcatagcccacgagtgcggccaccacgcctcagcgactac

SEQ ID NO: 38864 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38865 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctagcgggcctctgggtcatcgcccacgaatgcggccaccacgccttcagcgactac

SEQ ID NO: 38866 - DNA, 381 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgaatgcatctagatccaatgatcatgagcggagacctcaagaaagcaatcccacctcactgcttcaaacgctccatccctcgctccttctcctacctcctcttcgacatcctcgtctcctcctccctctaccacctctccacagcctacttcactctcctcccccaccctctcccttacctcgcctgacccctctactgggcctgccaaggctgcgtcctaacgggcctctgggtcatcgcccacgaatgcggccaccacgccttcagcgactac

SEQ ID NO: 38867 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacccacaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctaccctgacccctctactgggcctgccaaggctgcgtcctaacgggcctctgggtcatagcccacgagtgcggccaccacgccttcagcgactac

SEQ ID NO: 38868 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacagacctcaagaaagcaatcccacctcactgcttcaaacgctccatcccacgctccttctcctcttcgacatcatcatctcctcctcggctcctccctctaccacctctccacagcctacttccctctcctcccccaccctctccctaacctcgcctggcctctctactgggcctgccaagggtgcgtcctaaccggcgtctgggtcatagcccacgagtgcggccaccacgccttcagcgactac

SEQ ID NO: 38869 - DNA, 348 bp, Artificial
  Mutation in BnaC.FAD2.b introduced by TALE nuclease pair BnFAD2_T03
caggatccatgggtgcaggtggaagaatgcaagtgtctcctccctccagctccaccggaaccaacaccctcaaacgcgtcccctgcgagacaccaccattcactcggacctcaagaaagcaatcccacctcactgcttcaaacgctccatcccacgctccttctcctacctcctcttcgacatcctcgtctcctcctccctctaccacctctccacagcctacttccctctcctccccaccctctcccttacctcgcctggcccctctactgggcctgccaaggctgcgtcctaacgggcctctgggtcatagcccacgagtgcggccaccacgccttcagcgactac

SEQ ID NO: 38870 - DNA, 295 bp, Artificial
  Mutation in BnaC.FAD2.b introduced by TALE nuclease pair BnFAD2_T03
caggatccatgggtgcaggtggaagaatgcaagtctctcatccctccaggtagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgggccctctactgggcctgccaaggctgcgtcctaacgggcctctgggtcatcgcccacgaatgcggccaccacgccttcagcgactac

SEQ ID NO: 38871 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagaaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38872 - DNA, 452 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctggcgatggccaccacctgctccggggtcaagccgtgggcctggcacagcaccggcaacagccgctggaccgtctccagcgcctgcttgccaccattattgctggcgatgaaagacctcaagaaagcaatcccacctcactgcttcaaaccctccaccccacgctccttctcctcttcgacatcatcatctcctcctcgcctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 38873 - DNA, 348 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactagacctcaagaaagcaatcccacctcactgcttcaaacgctccatccctcgctccttctcctacctcctcttcgacatcctcgtgtcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38874 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 38875 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccctggaaccaacaccctcaaacgcgtcccctgcgagacaccaccattcacggagacctcaagaaagcaatcccacctcactgcttcaaacgctccatccctcgctccttctcctacctcctcttcgacatcctcgtctcctcctccctctaccacctctccacggcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38876 - DNA, 350 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38877 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccttccaaggctgcgtccttacgggcctctgggtcatagcccacgagtgcggccaccacgccttcagcaactac

SEQ ID NO: 38878 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38879 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacctcaagaaagcaatcccacctcactgcttcaaacgccccatcccacgccccttctcctcttccacatcatcatctcctcctcggctcctccctctaccacctctccacagcctccttccctctcccttacctcgcctgacccctctactgggcctgccaaggctgcgtcctaacgggcctctgggtcatcgcccacgaatgcggccaccacgccttcagcgactac

SEQ ID NO: 38880 - DNA, 404 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccaacaacatcaagcgcgtaccctgcgagacaccgcccttcactgtcgtctccagcgcctgcttgccgccatcgtggctggcgatggccaccacctgctccggactcaagaaagcaatcccacctcactgcttcaaacgctccatccctcgctccttctcatacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38881 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatggcccacgagtgcggccaccacgccttcagcgactac

SEQ ID NO: 38882 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcccttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38883 - DNA, 350 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcactctagacctcaagaaagcaatcccacctcactgcttcaaacgctccatccctcgctcattctcctacctcctcttcgacatcctcgtctcctcctccctctacaacctctccactgcctacttccctctcctcccccaccctctcccttacctcccctggcccctctactgggcctgccaaggctgcgtcctaacgggcctctgggtcttcgcccacgaatgcgtccaccacgccagcagcgactac

SEQ ID NO: 38884 - DNA, 351 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatcccacgctccttctcctcttctaccccatcatctcctcctcgcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38885 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38886 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctcctgggcctgccaaggctgcgtcctaacgggcctctgggtcatagcccacgagtgcggccaccacgccttcagcaactac

SEQ ID NO: 38887 - DNA, 332 bp, Artificial
  Mutation in BnaC.FAD2.b introduced by TALE nuclease pair BnFAD2_T03
caggatccatgggtgcaggtggaagaatgtaagtctctcctccctccagctcccccggaaccaacaccctcaaacgcgtcccctgcgagacaccaccattcacttcctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 38888 - DNA, 351 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccaccattcactctcagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38889 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 38890 - DNA, 397 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagccgaacgaccgagcgcagcgagtcagtgagcgaggaagcggaagagcgcccaatacgcggagacctcaagaacgcaatcccacctcactgcttcaaacgctccatcccacgctccttctcctcttcgacatcatcatctcctcctcggctcctccctctaccacctctccacagcctacttccctctcccttacctcgcctgacacctctactgggcctgccaaggctgcgtcctaacgggcctctgggtcatagcccacgagtgcggccaccacgccttcagcgactac

SEQ ID NO: 38891 - DNA, 336 bp, Artificial
  Mutation in BnaC.FAD2.b introduced by TALE nuclease pair BnFAD2_T03
caggatccatgggtgcagttggaagaatgcaagtgtctcctccctccaagaagtctgaaaccgacaccatcaagcgcgtaccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38892 - DNA, 350 bp, Artificial
  Mutation in BnaC.FAD2.b introduced by TALE nuclease pair BnFAD2_T03
caggatccatgggtgtaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38893 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 38894 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacatcctacttccctctcccttacctcgcctgacccctctactgggcctgccaaggctgcgtcctaacgggcctctgggtcatagcccacgagtgcggccaccacgccttcagcgactac

SEQ ID NO: 38895 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaccctcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38896 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatgctcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctcgcccctctactgggcctgccaaggctgcgtcctaacgggcctctggttcatcgcccacgaatgcggccaccacgccttcagcgactac

SEQ ID NO: 38897 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccgaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggccactctactgggcctgccaaggctgcgtcctaacgggcctctgggtcatcgcccacgaatgcggccaccacgccttcagcgactac

SEQ ID NO: 38898 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38899 - DNA, 342 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcaagaaagcaatcccacctcactgcttcaaacgctccatccctcgctccttctcctacctcctcttcgacatcctcgtctcatcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38900 - DNA, 321 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38901 - DNA, 316 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaactcctccctcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 38902 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacactcaaacgcgtcccctgcgagacaccacccttcactctacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38903 - DNA, 352 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38904 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacacgtcccctgcgagacaccacccttcactgacctcaagaaagcaatcccacctcactgcttcaaacgctccatccctcgctccttctcctacctcatcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38905 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38906 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggcggcgtcctaacgggcctctgggtcatagcccacgagtgcggccaccacgccttcagcgactac

SEQ ID NO: 38907 - DNA, 337 bp, Artificial
  Mutation in BnaC.FAD2.b introduced by TALE nuclease pair BnFAD2_T03
caggatccatgggtgcaggtggaagaatgcaagtctctcctccctccggctcccccggaaccaacaccctcaaacgcgtcccctgcgagacaccaccattcgctctaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38908 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccatctcccttacctcgcctggcccctctactgggcctgccaaggctgcgtcctaacgggcctctgggtcatcgcccacgaatgcggccaccacgccttcagcgactac

SEQ ID NO: 38909 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38910 - DNA, 349 bp, Artificial
  Mutation in BnaC.FAD2.b introduced by TALE nuclease pair BnFAD2_T03
caggatccatgggtacaggtggaagaatgcaagtctctcctccctccagctcccccgaaaccaaaaccctcaaacgcgtcccctgcgagacaccaccattcactcttacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 38911 - DNA, 370 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccgtccagcggctgttgccggtgttgtgcctggcggagacctcaagaaagcaatcccacctcactgcttcaaacgctccatcccacgctccttctcctcttcgacatcatcatctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 38912 - DNA, 419 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccggtccagcggctgttgccgccatcgtggctggcgatggccaccacctgctccggggtcaagccgtgggcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 38913 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 38914 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38915 - DNA, 425 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaggctccgcccccctgacgagcatcacaaaaatcgacgctcaagtcagaggtggcgaaacccgacaggactataaagataccaggcgtttccccctcaagaaagcaatcccacctcactgcttcaaacgctccatcccacgctccttctcctctccgacatcatcacctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 38916 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttagacctcaagaaagcaatcccacctcactgcttcaaacgctccatcccacgctccttctcctcttcgacatcatcatctcctcctcggctcctccctctaccacctctcctcccccaccctctcccttacctcgcctggcccctctactgggcctgccaaggctgcgtcctaacgggcctctgggtcatagcccacgagtgcggccaccacgccttcagcgactac

SEQ ID NO: 38917 - DNA, 294 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38918 - DNA, 362 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgcgatggcggcaagcaggcgctggagaagacctcaagaaagcaatcccacctcactgcttcaaacgctccatcccacgctccttctcctcttcgacatcatcatctcctcctcgctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38919 - DNA, 377 bp, Artificial
  Mutation in BnaC.FAD2.b introduced by TALE nuclease pair BnFAD2_T03
aaggatccatgggtgcaggtggaagaatgcaagtctctcctccctccagctcccccggaaccaacaccctcaaacgcgtcccctgcgagacaccaccattcactctcgcctgcttgccaccgccattgctggcgatggccaccacctttgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38920 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcggagacctcaagaaagcaatcccacctcactgcttcaaacactccatccctcgctccttctcctacctcctcttcgacatcctcgtctcctcctccctctaccacctctccacagcctacttccctctcctcccccaccctctcccttgcctcgcccggcccctctactgggcctgccaaggctgcgtcctaacgggcctctgggtcatcgcccacgaatgcggccaccacgccttcagcgactac

SEQ ID NO: 38921 - DNA, 449 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttgctgctggctggcttcagcagagcgcagataccaaatactgttcttctagtgtagccgtcgccagcccagtcgggcggcgagttccatagcgttaagtgcaacaaattgatgagaactcaagaaagcaatcccacctcactgcttcaaacgctccatcccccgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38922 - DNA, 335 bp, Artificial
  Mutation in BnaC.FAD2.b introduced by TALE nuclease pair BnFAD2_T03
caggatccatgtgtgcaggtggaagaatgcaagtgtctcctccctccaagaagtctgaaaccgacaccatcaagcgcgtaccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 38923 - DNA, 332 bp, Artificial
  Mutation in BnaC.FAD2.b introduced by TALE nuclease pair BnFAD2_T03
caggtccatgggtgcaggtggaagaatgcaagtctctcctccctccagctcccccggaaccaacaccctcaaacgcgtcccctgcgagacaccaccattcacttacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38924 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctcttcgacatcatcatctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 38925 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaacccaagaaaacaatcccacctcactgttgcaaacgctccaccccaccctccttctcctcttcgccatcctcatctcctcctcggcccctccctctaccacctctccacagcctcctaccctctcccttacctcgcctgacccctctactgggcctgccaaggctgcgtcctaacgggcctctgggtcatagcccacgagtgcggccaccacgccttcagcgactac

SEQ ID NO: 38926 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 38927 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccctacctcgcctggcccctctactgggcctgccaaggctgcgtcctaacgggcctctgggtcatcgcccacgaatgcggccaccacgccttcagcgactac

SEQ ID NO: 38928 - DNA, 348 bp, Artificial
  Mutation in BnaC.FAD2.b introduced by TALE nuclease pair BnFAD2_T03
caggatcatgggtgcaggtggaacaatgcaagtgtctcctccctccaagaagtctgaaaccgacaccatcaagcgcgtaccctgcgagacaccgcccttcactgtatcatcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38929 - DNA, 345 bp, Artificial
  Mutation in BnaC.FAD2.b introduced by TALE nuclease pair BnFAD2_T03
caggatccatgggtgcaggtgcaagaatgcaagtctctcctccctccagctcccccgaaaccaaaaccctcaaacgcgtcccctgcgagacaccacccttcacccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38930 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 38931 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 38932 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcgggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38933 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccatcggagacctcaagaaagcaatcccacctcactgcttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38934 - DNA, 388 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggagagcgttcaccgacaaacaacagataaaacgaaaggcccagtcacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccatcagcgactac

SEQ ID NO: 38935 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 38936 - DNA, 332 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 38937 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 38938 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcactccttctcctacctcctcttcgacatcctcgtctcctcctcggctcctccctctaccacctctccacagcctacttccctctcccttacctcgcctgacccctctactggacctgccaaggctgcgtcctaacgggcctctggggcatagcccacgagtgcggccaccacgccttcagcgactac

SEQ ID NO: 38939 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactataccacaagaaagcaatcccacctcactgcttcaaacgctccatcccacgccccttctcctcttcgacatcatcatcgcctcctcggctcctccctctaccacctctccacagcctacttccctctcccttacctcgcctggcccctctactgggcctgccaaggctgcgtcctaacgggcctctgggtcatcgcccacgagtgcggccaccacgccttcagcgactac

SEQ ID NO: 38940 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacctcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38941 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38942 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38943 - DNA, 317 bp, Artificial
  Mutation in BnaC.FAD2.b introduced by TALE nuclease pair BnFAD2_T03
caggatccatgggtgcaggtggaagaatgcaagtctttccttcctccagctcccccggaaccaacaccctcaaacgcgtcccctgcgagacaccacccttcactctcccacctcactgcttcaaaccctccatccctcgctccttctcctacctcctcttcgacatcctcgtctcctcctccctctaccacctctccacagcctacttccctctcccttacctcccctgacccctctaccgggcctgccaaggctgcgtcctaactggcctctggttcatagcccacgagggcggccaccacgccttcagcgactac

SEQ ID NO: 38944 - DNA, 332 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38945 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctacctcctcttcgacatcctcgtctcctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 38946 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctccctcaacctctctcctacttcgcctggcctctctactgggcctgccagggctgcgtcctaaccggcgtctgggtcatagcccacgagtgcggccaccacgccttcagcgactac

SEQ ID NO: 38947 - DNA, 281 bp, Artificial
  Mutation in BnaC.FAD2.b introduced by TALE nuclease pair BnFAD2_T03
caggatccatgggtgcaggtggaagaatgcaagtctcgacctcaagaaagcaatcccacctcactgcttcaaacgctccatcacacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38948 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38949 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgtgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaagactgcgtcctaacgggcctctgggtcatagcccacgagtgcggccaccacgccttcagcgactac

SEQ ID NO: 38950 - DNA, 376 bp, Artificial
  Mutation in BnaC.FAD2.b introduced by TALE nuclease pair BnFAD2_T03
caggatccatgggtgcaggtggaagaatgcaagtgtctactccctccaagaagtctgaaaccgacaccataaagcgcgtcccctgcgagacaccacccttcactctgctgcgtaacatcgttgctgctccagagacctcaagaaagcaatcccacctcactgcttcaaacgctccatccctcgctccttctcctacctcctcttcgacatcctcgtctcctcctccctctaccacctctccacagcctacttccctctcctcccccaccctctccctgacctcgcctggcccctctactgggcctgccaaggctgcgtcctaacgggcctctgggtcatcgcccacgaatgcggccaccacgccttcagtaactac

SEQ ID NO: 38951 - DNA, 350 bp, Artificial
  Mutation in BnaC.FAD2.b introduced by TALE nuclease pair BnFAD2_T03
caggatccatgggtgcaggtggaagaatgaaagtctctcctccctccagctcccccgaaaccaaaaccctcaaacgcgtcccctgcgagacaccacccttcactctagacctcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 38952 - DNA, 331 bp, Artificial
  Mutation in BnaC.FAD2.b introduced by TALE nuclease pair BnFAD2_T03
caggatccatgggtgcaggtggaagaatgcaagtgtcttctccctccaagaagtctgaaaccgacaacatcaagcgcgtaccctgcgagacaccgcccttcactgactcaagaaagcaatccacctcactgcttcaaacgctccatcccacgctccttctcctcttcgacatcatcatctcctcctcggctcctccctctaccacctctccacagcctacttccctctcccttacctcgcccgacccctctactgggcctgccaaggctgcgtcctaacgggcctctgggtcatagcccacgagtgcggccaccacgccttcagcgactac

SEQ ID NO: 38953 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38954 - DNA, 294 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38955 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacggagacctcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38956 - DNA, 430 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttaggctccgcccccctgacgagcatcacaaaaatcgacgctcatccagcgcctgttgccggtgctgtgccaggcccacggagacctcaagaaagcaatcccacctcactgcttcaaacgctccatccctcgctccttctcctacctcctctccgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgcctac

SEQ ID NO: 38957 - DNA, 336 bp, Artificial
  Mutation in BnaC.FAD2.b introduced by TALE nuclease pair BnFAD2_T03
caggatccatgggtgcaggtggaagaatgcaagtctctcctccctccagcccccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38958 - DNA, 367 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcatcaaactaagcagaaggccatccgtcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38959 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38960 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagagacctcaagaaagcaatcccacctcactgcttcaaacgctccatcccacgctccttctcctcttcgacatcatcatctcctcctcggctcctccctctaccacctctccacagcctacttccctctctcctacttcgcctggcctctctactgggcctgccagggctgcgtcctaaccggcgtctgggtcatagcccacgagtgcggccaccacgccttcagcgactac

SEQ ID NO: 38961 - DNA, 296 bp, Artificial
  Mutation in BnaC.FAD2.b introduced by TALE nuclease pair BnFAD2_T03
caggatccatgggtgcaggtggaagattgcaagtctctcctccctccagctcccccggaaccaacaccctcaaacgcgtcccctgcgagacaccaccatcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38962 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtccactgcgagacaccaccattcactcggagacctcaagaaagcaatcccacctcactgcttcaaacgctccatcccacgctccttctcctcttcgacatcatcatctcctcctcggctcctccctctaccacctctccacagcctaattccctctcccttacctcgcctgacccctctactgggactgccaaggctgcgtcctaacgggcctctgggtcatagcccacgagtgcggccaccacgccttcagcgactac

SEQ ID NO: 38963 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccgcgagtgcggccaccacgccttcagcgactac

SEQ ID NO: 38964 - DNA, 346 bp, Artificial
  Mutation in BnaC.FAD2.b introduced by TALE nuclease pair BnFAD2_T03
caggatccatgggtgcaggtggaagaatgcaagtctcacatcccaccagctcccccgaaaccaaaaccctcaaacgcgtcccctgcgagacaccacccttcactctgtagagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccagggctgcgtccgaaccggcgtcggggtcatagccctcgagtgcggccaccacgccctcagcaactac

SEQ ID NO: 38965 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 38966 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38967 - DNA, 385 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcaaatatttcttgtcaaaaatgctccactgacgttccataaattcccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38968 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38969 - DNA, 279 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38970 - DNA, 379 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggggggtcaagccgtgggcctggcacagcaccggcaacagccgcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactcc

SEQ ID NO: 38971 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38972 - DNA, 374 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccacctcactgcttcaaacgctccatccctcgctccttctcctacctcctcttcgacatcctcgtctcctcctccctctaccacctctccacagcctacttccctctcctcccccacccccccccctccgccctcctccccccccccccccaccctctcccttacctcgcctggcccctctactgggcctgccaaggctgcgtcctaacgggcctctgggtcatcgcccacgaatgcggccaccacgccttcagcgactac

SEQ ID NO: 38973 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcgaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38974 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctacctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38975 - DNA, 359 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactgattataagttacttactagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 38976 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38977 - DNA, 475 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtgtaacggtggacaccgccattgctggcgatggccaccacctgctggggggtcaagccgtgggcctggcacctgctccggggtcaagccgtgggccagccacgatggcggcaagcaggcgctggagagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38978 - DNA, 288 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 38979 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccatcaaacgcgtcccctgcgagacaccaccattcactgagacctcaagaaagaaatcccacctcactgcttcaaactctccatcccacgctccttctcctcttcgccatcatcatctcctcctcatctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 38980 - DNA, 332 bp, Artificial
  Mutation in BnaC.FAD2.b introduced by TALE nuclease pair BnFAD2_T03
caggatccatgggtgcaggtggaagaatgcaagtctctcctccctccagctaccccgaaaccaaaaccctcaaacgcgtcccctgcgagacaccacccttcactacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggtctgccagggctgcgtcctaaccggcgtctgggtcatagcccacgagtgctgccaccacgccttcagcgactac

SEQ ID NO: 38981 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38982 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctccctctaccacctctccacagcctacttccctctcctccaccaccctctcccttacctcgcctggcccctctactgggcctgccaaggctgcgtcctaacgggcctctgggtcatcgcccacgaatgcggccaccacgccttcagcgactac

SEQ ID NO: 38983 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38984 - DNA, 335 bp, Artificial
  Mutation in BnaC.FAD2.b introduced by TALE nuclease pair BnFAD2_T03
caggatccatgggtgcaggtggaagaatgcaagtctctcctccctcccgctcccccgaaaccaaaacactcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38985 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactaagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38986 - DNA, 336 bp, Artificial
  Mutation in BnaC.FAD2.b introduced by TALE nuclease pair BnFAD2_T03
caggatccatgggtgcaggtggaagaatgcaagtctctcctccctccagctccaccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38987 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38988 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 38989 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacacacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38990 - DNA, 359 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttagacctcaagaaagcaatcccacctcactgcttcaaacgctccatccctcgctccttctcctacctcctcttcgacatcatcatctcctcctcggctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 38991 - DNA, 333 bp, Artificial
  Mutation in BnaC.FAD2.b introduced by TALE nuclease pair BnFAD2_T03
caggatccatgggtgcaggtggaagaatgcaagtgtctcctccctcagcttccccggaaccaacaccctcaaacgcgtcccctgcgagacaccaccattcactctgacctcaagaaagcaatcccaccccactgcttcaagccctccatcccacgctcctcctcctacctcctcttcgacatcctcgtctcctcctccctctaccacctctccacagccgccttccctctcccttacctcgcctgacccctctactgggcctgccaaggctgcgtcctaacgggcctctgggtcatagcccacgagtgcggccaccacgccttcagcgactac

SEQ ID NO: 38992 - DNA, 392 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgtaatctggaacatcgtatgggtaatcgatgaccttacgtttaaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38993 - DNA, 303 bp, Artificial
  Mutation in BnaC.FAD2.b introduced by TALE nuclease pair BnFAD2_T03
caggatccatgggtgcaggtagaagaatgcaagtgtctcctccctccagctcccccggaaccaacaccctcaaacgcgtcccctgcgagacaccacctcactgcttcaaacgctccatctcacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 38994 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctccatccctcgctacttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgtggccaccacgccttcagcgactac

SEQ ID NO: 38995 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 38996 - DNA, 469 bp, Artificial
  Mutation in BnaC.FAD2.b introduced by TALE nuclease pair BnFAD2_T03
caggacccatgggtgcaggtggaagagtgcaagtctctcctccctccagctcccccgaaaccaaaaccctcaaacgcgtcccctgcgagacaccacccttcactctcggtggccatcgccagcaataatggtggcaagcaggcgctggagacggtccagaggctgttgccggtgctgtgccagtcccacggcttgaccccccagcaggtggtggccatcgccggagacctcaagaaagcaatcccaccccactgcttcaaacgctccaccccacgctccttctcctcttcgtcatcaccatctcctcctcggctcctccctctaccacctctccacagcctacttccctctccgcccccaccctctcccttgcctcgcctggcccctctactgggcctgccaaggctgcgtcctaacgggcctctggggcatcgcccacgaatgcggccaccacgccttcagcgactac

SEQ ID NO: 38997 - DNA, 455 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggtcaagccgtgggcctggcacagcaccggcaacagccgctggaccgtctccagcgcctgcttgccgccatcgtggctggcgatggccaccacctgctccggagaactcaagaaagcaatcccacctcactgcttcaaacgctccacccctcgctccttctcctccctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 38998 - DNA, 351 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 38999 - DNA, 353 bp, Artificial
  Mutation in BnaC.FAD2.b introduced by TALE nuclease pair BnFAD2_T03
caggatccatgggtgcaggtggaagaatgcaagtgtctcctccctccaactcgtctgaaaccgacaccctcaagcgcgtcccctgcgagacaccacccttcactctcacctcactcaagaaagcaatcccacctcactgtttcacacgctccatccctcgctctttctcctacctcatctccgactccctcctctcctcctccctctaccaccccgccacagcctacttccctctccccccccaccctctcccttacctcgcctggcccctctactgggcctgccaaggctgcgtcctaacgggcctctgggtcatagcccacgagtgcggccaccacgccttcagcgactac

SEQ ID NO: 39000 - DNA, 330 bp, Artificial
  Mutation in BnaC.FAD2.b introduced by TALE nuclease pair BnFAD2_T03
caggatccatgggtgcaggtggaagaatgcaagtctctcctccctccagctctcccggaaccaacaccctcaaacgcgtcccctgtagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39001 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactaaagcaatcctacctcacttcttcaaacgctccatccctcgctccttctcctacctcatctgggacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 39002 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggagacctcaagaaagcaatcccacctcactgcttcaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39003 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39004 - DNA, 334 bp, Artificial
  Mutation in BnaC.FAD2.b introduced by TALE nuclease pair BnFAD2_T03
caggatccatgggtgcaggtggaagaatgcaagtctctcctccctccagctccaccggaaccaacaccctcaaacgcgtcccctgccagacaccaccattcacaagacctcaagaaagcaatcccacctcactgcttcaaacgctccatcccacgctccttctcctcttcgacatcatcatctcctcctcggcgcctccctctaccacctctccacagcctacttccctctcccttacctcgcctgtcccctctacggggcctgccaagcctgcgtcctaacgtgcctctggttcatagcccacgagtgcggccaccacgccttcagcgactac

SEQ ID NO: 39005 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39006 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatcccacgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39007 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39008 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccacctcactgcttcaaacgctccatccctcgctccttctcctacctcctcttcgacatcctcgtctcctcctccctctaccacgtctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39009 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgagacctcaagaaagcaatcccacctcactgcttcaaacgctccatcccacgctccttctcctcttcgacatcatcatctcctcctcggctcctacctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39010 - DNA, 410 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagggaaacccgaagtttccaaaaggtcgttgataaaagctcgccgcgttgtttcatcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 39011 - DNA, 346 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39012 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactgagacctcaagaaagcaatcccacctcactgcttcaaatgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgccttcagcgatac

SEQ ID NO: 39013 - DNA, 346 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39014 - DNA, 352 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtggagaactcaagaaagcaatcccacctcactgcttcaaacgctccatccctcgctccttctcctacctcctcttcgacatcctcgtctcctcctccctctaccacctctccacagcctacttccctctccccccccaccctctcccttacctcgcctggcccctctactgggcctgccagggctgcgtcctaaccggcgtctgggtcatagcccacgagtgcggccaccacgccttcagcgactac

SEQ ID NO: 39015 - DNA, 349 bp, Artificial
  Mutation in BnaC.FAD2.b introduced by TALE nuclease pair BnFAD2_T03
caggatccatgggtgcaggtcgaagaatgcaagtctctcctccctccagctcccccgaaaccaaaaccctcaaacgcgtcccctgcgagacaccacccttcactctgacctcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39016 - DNA, 346 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactccctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatacggccaccacgccttcagcgactac

SEQ ID NO: 39017 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctggcccctctactgggcctgccaaggctgcgtcctaacgggcctctgggtcatcgcccacgaatgcggccaccacgccttcagcgactac

SEQ ID NO: 39018 - DNA, 336 bp, Artificial
  Mutation in BnaC.FAD2.b introduced by TALE nuclease pair BnFAD2_T03
caggatccatgggtgcaggtgtaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39019 - DNA, 257 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcctcggctcctccctctaccacctctccacagcctacttccctctcccttacctcgcctgacccctctactgggcctgccaaggctgcgtcctaacgggcctctgggtcatagcccacgagtgctgccaccacgccttcagcgactac

SEQ ID NO: 39020 - DNA, 368 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagcaatggcggtggctggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39021 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39022 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacccccaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39023 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcacttagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 39024 - DNA, 395 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggctgcggcgagcggtatcagctcactcaaaggcggtaatacggttatccacagaatcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaacgggcctctgggtcatcgcccacgaatgcggccaccacgccttcagcgactac

SEQ ID NO: 39025 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 39026 - DNA, 330 bp, Artificial
  Mutation in BnaC.FAD2.b introduced by TALE nuclease pair BnFAD2_T03
caggatccatgggtgcaggaggaagaatgcaagtctctcctccctccagctcccccggaaccaacaccctcaaacgcgtcccctgcgagacaccaccattcaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39027 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaacacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39028 - DNA, 343 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctccatcccacgctccttctcctcttcgacatcctcgtctcctcctccctctaccacctctccacagcctacttccctctcctcccccaccctctcccttacctcgccgggcccctctactgggcctgccaaggctgcgtcctaacgggcctcggggtcatcgcccacgaatgcggccaccacgccttcagcgactac

SEQ ID NO: 39029 - DNA, 401 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggggggaaagccggcgaacgtggcgagaaaggaagggaagaaagcgaaaggagcgggcgctaggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39030 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgtggccaccacgccttcagcgactac

SEQ ID NO: 39031 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccccgcgagacaccacccttcactctcgaccccaagaaagcaatcccacctcactgcttctaccgatccacccctcccccctcctcctccccccccaccgccatatgcgttccctccctcctctcccacctctccacagcctacttccctcccccccccccccctctcccttccctcgcctggcccctctactgggcctgccaaggctgcgtcctaacgggcctctgggtcatcgcccacgagtgcggccaccacgccttcagcgactac

SEQ ID NO: 39032 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgtgtcctaacgggcctctggggcatcgcccacgaatgcggccaccacgccttcagcgactac

SEQ ID NO: 39033 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39034 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctccgagacaccaccattcactcagacctcaagaaagcaatcccacctcactgcttcaaacgctccatcccaccctccttctcctcttcgacatcatcatctcctcctcggctcctccctctaccacctctccacagcctacttccctctcccttacctcgcctgacccctctactgggcctgccatggctgcgtcctaacgggcctctgggtcatagcccacgagtgcggccaccacgccttcagcgactac

SEQ ID NO: 39035 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 39036 - DNA, 372 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagcggctgttgccggtgctgtgccaggcccccgctcaatcccacctcactgcttcaaacgctccatccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatagcccacgagtgcggccaccacgccttcagcgactac

SEQ ID NO: 39037 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagttgccggtgctgtgccaggcccacggcttgaccccccagcaggtggtggccatcgccagcagacctcaagaaagcaatcccacctcactgcttcaaacgctccatcccacgctccttctcctcttcgacatcatcatctcctcctcggctcctccctctaccacctctccacagcctacttccctctcccttgcctcgcctgacccctctactgggcctgccagggctgcgtcctaaccggcgtctgggtcatagcccacgagtgcggccaccacgccttcagcgactac

SEQ ID NO: 39038 - DNA, 419 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctctgacttgagcgtcgatttttgtgatgctcgtcagggggggccatcgccagcaatggcggcggcaggccggcgctgggacctcaagaaagcaatcccacctcactgcttcaaacgctccatcccacgctccttctcctcttcgacatcatcatctccgcctcggctcctccctctaccacctctccacagcctacttccctcgcctcccccaccctctcccttacctcgcctggcccctctactgggcctgccaaggctgcgtcctaacgggcctctgggtcatcgcccacgaatgcggccaccacgccttcagcgactac

SEQ ID NO: 39039 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcaactac

SEQ ID NO: 39040 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagtgactac

SEQ ID NO: 39041 - DNA, 361 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaggcgctggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 39042 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39043 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacagacctcaagaaagcaatcccacctcactgcttcaaacgctccatcccacgctccttctcctcttcgacatcatcatctcctcctcggctcctccctctaccacctctccacagcctacttccctctcccttacctctcctgacccctctactgggcctgccaaggctgcgtcctaacgggcctctgggtcatagcccacgagtgcggccaccacgccttcagcgactac

SEQ ID NO: 39044 - DNA, 265 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39045 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaagcaagccatcccacctcacttcttcaacccctccatcccacgctccttctcctcttcgacatcatcctctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 39046 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaacctcaagaaagcaatcccacctcactgcttcaaacgctccatccctcgctacttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccatcagcgactac

SEQ ID NO: 39047 - DNA, 295 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 39048 - DNA, 422 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctcggcgctggagacggtccagcggctgttgccggtgctgtgccaggcccacggcttgaccccccagcaggtggtggccatagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39049 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcttcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatagcccacgagtgcggccaccacgccttcagcgactac

SEQ ID NO: 39050 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39051 - DNA, 350 bp, Artificial
  Mutation in BnaC.FAD2.b introduced by TALE nuclease pair BnFAD2_T03
caggatccatgggtgcaggtgaaagaatgcaagtctctcatccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 39052 - DNA, 336 bp, Artificial
  Mutation in BnaC.FAD2.b introduced by TALE nuclease pair BnFAD2_T03
caggatccatgagtgcaggtggaagaatgcaagtctatcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaagggtgcgtcctaacgggcctctgggtcatagcccacgagttcggccaccacgccttcaacaactac

SEQ ID NO: 39053 - DNA, 337 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacttggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagtccacgagtgcggcctccacgccttcagcgactac

SEQ ID NO: 39054 - DNA, 327 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaaagcaatcccacctcactgcttcaaacgctccatcccacgctccttctcctcttcgacatcatcatctcctcctcggctactccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39055 - DNA, 333 bp, Artificial
  Mutation in BnaC.FAD2.b introduced by TALE nuclease pair BnFAD2_T03
caggatccatgggtgcaggtgaaagaatgcaagtctctcctccctccagctcccccggaaccaacaccctcaaacgcgtcccctgcgagacaccaccattcacttacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 39056 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagaccccaagaaagcaatcccacctcactgcttcaaacactccatcccacgctccttctcctcttcgacatcatcatctcctccccggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39057 - DNA, 295 bp, Artificial
  Mutation in BnaC.FAD2.b introduced by TALE nuclease pair BnFAD2_T03
caggatccatgggtgcaggtggaagaatgcaagtctctcatccctccaggtagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctggttcatcgcccacgaatgcggccaccacgccttcagcgactac

SEQ ID NO: 39058 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctaactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 39059 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39060 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcataaccggcgtctgggtcatagcccacgagtgcggccaccacgccttcagcgactac

SEQ ID NO: 39061 - DNA, 388 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgcgttatcccctgattctgtggataaccgtattaccgagacctcaagaaagcaatcccacctcactgcctcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39062 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcccgccaaggctgcgtcctaacgggcctctgggtcatagcccacgagtgcggccaccacgccttcagcgactac

SEQ ID NO: 39063 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctcactctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39064 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgattgcggccaccacgccttcagcgactac

SEQ ID NO: 39065 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgcgacctcaacaaagcaatcctacctcactgcttctaacgctccatcccaccccacttctcctcttcgcaatcctcatctcctcttctgcccctccccctaccacctctccacagcctacttccctctcccctacctcgcctgacccctctactgggcctgccaagggtgcgtccgaacgggcctctgggtcatcgcccacgaatgcggccaccacgccttcagcgactac

SEQ ID NO: 39066 - DNA, 335 bp, Artificial
  Mutation in BnaC.FAD2.b introduced by TALE nuclease pair BnFAD2_T03
caggatccatgagtgcagggggaagaatgcaagtctgtcccccctccagctccccagaaaacaaaaccctcaaccgcgtcccctgcgagacaccacccttcactaagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccatcagcaactac

SEQ ID NO: 39067 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 39068 - DNA, 392 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgtaatctggaacatcgtatgggtaatcgatgaccttacgtttaaactcaagaaagcaatcccaccgcactgtttcaaacgctcgatccctcgctctttctcctacctcctcttcgacatcctcgtctcctcctccctctaccacctctccacaacctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39069 - DNA, 330 bp, Artificial
  Mutation in BnaC.FAD2.b introduced by TALE nuclease pair BnFAD2_T03
caggatccatgggtgcaggtgggagaatgcaagtctctcctccctccagctcccccggaaccaacaccctcaaacgcgtcccctgcgagacaccaccattcacacctcaagaaagcaatcccacctcactgcttcaaacgctccatcccacgctccttctcctacctcctcttcgacatcctcgtctcctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 39070 - DNA, 346 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39071 - DNA, 347 bp, Artificial
  Mutation in BnaC.FAD2.b introduced by TALE nuclease pair BnFAD2_T03
caggatccatgggtgcaggtgaaagaatgcaagtctctcctccctccagctcccccgaaaccaaaaccctcaaccgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcggggtcatcgcccgcgaatgcggcctccacgccttcagcgactac

SEQ ID NO: 39072 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaaccctccatcccacgccccttctcctcttcgacatcatcatctcctcctcgtctcctccctctaccacctctccacagcctacttccctctcctcccccaccctctccctttcctcgcctggcccctctactgggcctgccaaggctgcgtcctaacgggcctctgggtcatcgcccacgaatgcggccaccacgccttcagcgactac

SEQ ID NO: 39073 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagaactcaagaaagcaatccaaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39074 - DNA, 348 bp, Artificial
  Mutation in BnaC.FAD2.b introduced by TALE nuclease pair BnFAD2_T03
caggatccatgggtgcaggtggaagaatgcaagtctctcctccctccagctccaccgaaaccaaaaccctcaaacgcgtcccctgcgagacaccacccttcactcaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggtccctctactgggcctgccaaggctgcgtcctaacgtgcctctgggtcatcgcccacgaatgcggccaccacgccttcagcgactac

SEQ ID NO: 39075 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 39076 - DNA, 334 bp, Artificial
  Mutation in BnaC.FAD2.b introduced by TALE nuclease pair BnFAD2_T03
caggatccatgggtgcaggtgggagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39077 - DNA, 366 bp, Artificial
  Mutation in BnaC.FAD2.b introduced by TALE nuclease pair BnFAD2_T03
caggatccatgggtgcaggaggaagaatgcaagtctctcctccctccagctcccccgaaaccaaaaccctcaaacgcgtcccctgcgagacaccacccttcactgattataagttacttactagacctcaataaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39078 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggtccctctactgggcctgccaaggcttcgtcctaacgggcctctgggtcatcgcccacgaatgcggccaccacgccttcagcgactac

SEQ ID NO: 39079 - DNA, 362 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgctgcgtaacatcgttgctgctccagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 39080 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 39081 - DNA, 335 bp, Artificial
  Mutation in BnaC.FAD2.b introduced by TALE nuclease pair BnFAD2_T03
caggatccatgggtgcaggtgcaagaatgcaagtctctcctccctccagctcccccgaaaccaaaaccctcaaacgcgtcccctgcgagacaccacccttcactaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39082 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccatgagtgcggccaccacgccttcagcgactac

SEQ ID NO: 39083 - DNA, 461 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgttaggcgacttttgaacgcgcaataatggtttctgacgtatgtgcttgcccacggcttgaccccggagcaggtggtggccatcgccagccacgatggggcgctggcaagtgtagtggttacgcgcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39084 - DNA, 349 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 39085 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgtcaaggctgcgtcctaacgggcctctgggtcatagcccacgagtgcggccaccacgccttcagcgactac

SEQ ID NO: 39086 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaacaacaccctcaaacgcgtcccctgcgagacaccacccttcactcgagacctcaagaaagcaatcccacctcactgcttcaaacgctccatccctcgctccttctcctacctcctcttcgacatccgcgtctcctcctccctctaccacctctccacagcctacttccctctcctccctcaccctctctcctgcctcacctggcctctctacggggcctgccaaggctgcgtccgaacgggcctctgggtcatcgcccacgaatgcggccaccacgccatcagcgactac

SEQ ID NO: 39087 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagaccccaccattcactcagacctcaagaaagcaatcccacctcactgcttcaaacgccccatcccacgctccttctcctcttcgacatcatcatctcctcctcggctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 39088 - DNA, 344 bp, Artificial
  Mutation in BnaC.FAD2.b introduced by TALE nuclease pair BnFAD2_T03
caggatccatgggtgcaggtggaagaatgcaagtctctcatccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39089 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39090 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 39091 - DNA, 408 bp, Artificial
  Mutation in BnaC.FAD2.b introduced by TALE nuclease pair BnFAD2_T03
caggatccatgggtgcaggtgcaagaatgcaagtctctcctccctccagctcccccggaaccaacaccctcaaacgcgtcccctgcgagacaccaccattcactctcggagacggtccagcggctgttgccggtgctgtgccaggcccacggtccagcgcctgcttgccggagacctcaagaaagcaatcccacctcactgcttcaaacgccccatcccacgctccttctcctcttcgacatcctcgtctcctcctccctctaccacctctccacagcctacttccccctcctcccccaccctctcccttacctcgcctggcccctctactgggcctgccaaggctgcgtcctaacgggcctctgggtcatcgcccacgagtgcggccaccacgccttcagcgactac

SEQ ID NO: 39092 - DNA, 419 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcggcaacagccgctggaccgtctccagcgcctgcttgccaccattattgctggcgatggccaccacctgccatctcacgttccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39093 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctccatccctcgctccttctcctacctcctcttcgacatcctcgtctcctcctccctctaccacctctccacagcctacttccctctcctcccccaccctctctcctacctcgcctgacccctctactgggcctgccaaggctgcgtcctaacgggcctctgggttatcgcccacgaatgcggccaccacgcctttcagcgactac

SEQ ID NO: 39094 - DNA, 340 bp, Artificial
  Mutation in BnaC.FAD2.b introduced by TALE nuclease pair BnFAD2_T03
caggatccatgggtgcagatacaagaatgcaagtctctcctccctccagctcccccggacccaacaccctcaaacgcgtcccctgcgagacaccaccattcactctcgggagacctcaagaaagcaatcccccctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggcctccacgccttcagcgactac

SEQ ID NO: 39095 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39096 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 39097 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagaaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39098 - DNA, 343 bp, Artificial
  Mutation in BnaC.FAD2.b introduced by TALE nuclease pair BnFAD2_T03
caggatccatgggtgcaggtggaagaatgcaagtctctcctccctcccgctcccccggaaccaacacactcaaacgcgtcccctgcgagacaccaccattcactctcggaaagcaatcccacctcactgcttcaaacgctccatccctcgcaccttctcctacctcctcttcgacatcctcgtctcctcctccctctaccacctctccacagcctacttccctctcctcccccaccctctccctcacctcgcctggcccctctacccggcctgccaaggctgcgtcctaacgggcctcggggtcagcgcccaccaatccggctaccacgccttcatcgactac

SEQ ID NO: 39099 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 39100 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcgctctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39101 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 39102 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctctgctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39103 - DNA, 257 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39104 - DNA, 334 bp, Artificial
  Mutation in BnaC.FAD2.b introduced by TALE nuclease pair BnFAD2_T03
caggatccatgggtgcaggtgtaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggcgcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39105 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 39106 - DNA, 332 bp, Artificial
  Mutation in BnaC.FAD2.b introduced by TALE nuclease pair BnFAD2_T03
caggatccatgggtgcaggtggaagaatgcaagtctctcctccctccagatcccccggaaccaacaccctcaaacgcgtcccctgcgagacaccaccattcactacctcaagaaagcaatcccccctcactgcttcaaacgctccatcccaccctccttctcctcttcgacatcatcatctcctcctcggctcctccctctaccacctctccacagcctacttccctctcccttccctcgcctgccccctccactgggcctgccaagcctccgtcctaacggccctctgggtcataacccacgagtgcggccacctcgccttcatcaactac

SEQ ID NO: 39107 - DNA, 294 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaagaaagcaatcccacctcactgctccaaactctccatcccactctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 39108 - DNA, 285 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaagaaagcaatcccacctcactgcttcaaacgctccatccctcgctccttctcctacctcctcttcgacatcctcgtctcctcctccctctaccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 39109 - DNA, 279 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39110 - DNA, 316 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtagaactcaagaaagcaatcccaccgcactgtttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39111 - DNA, 337 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcacttctagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 39112 - DNA, 349 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccaccattcactctgacctcaagaaagcaatcccacctcactgcttcaaacgctccatccctcgctccttctcctacctcctcttcgacatcctcgtctcctcctccctctaccacctctccacagcctacttccctctccccccccaccccctctcctacttcgcctggcctctctactgggcctgccaagggtgcgtcctaacgggcctctgggtcatagcccacgagtgcggccacctcgccttcagcgactac

SEQ ID NO: 39113 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtaccctgcgagacaccaccattagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39114 - DNA, 348 bp, Artificial
  Mutation in BnaC.FAD2.b introduced by TALE nuclease pair BnFAD2_T03
caggatccatgggtgcaggtggagaatgcaagtctctcctccctccaagaagtctgaaaccgacaccatcaagcgcgtaccctgcgagacaccgcccttcactgtaaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 39115 - DNA, 431 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactctcggctgttgccggtgctgtgccaggcccacggcttgaccccccagcaggtggtggccatcgccagcaatggcggtggcaagcaggcgctggagacggaccacaagaaagcaatcccacctcactgcttcaaacgctccatcccacgctccttctcctcttcgacatcatcatctcctcctcggctcctccctctcccacctccccacagcctacttccctctcccttacctcgcctgacccctctactgggcctgccaaggctgcgtcctaacgggcctctgggtcatagcccacgagtgcggccaccacgccttcagcgactac

SEQ ID NO: 39116 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39117 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaatgctgcgtcctaacgggcctctgggtcatagcccacgagtgcgtccaccacgccttcacgactac

SEQ ID NO: 39118 - DNA, 336 bp, Artificial
  Mutation in BnaC.FAD2.b introduced by TALE nuclease pair BnFAD2_T03
caggatccatgggtgcaggtagaagaatgcaagtctctcctccctccagctcccccgaaaccaaaaccctcaaacgcgtcccctgcgagacaccacccttcactctccatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39119 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagaaagcaatcccacctcactgcttcaaacgctctatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 39120 - DNA, 328 bp, Artificial
  Mutation in BnaC.FAD2.b introduced by TALE nuclease pair BnFAD2_T03
caggtccatgggtgcaggtggaagaatgcaagtctctcctccctccagctcccccggaaccaacaccctcaaacgcgtcccctgcgagacaccaccattcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39121 - DNA, 305 bp, Artificial
  Mutation in BnaC.FAD2.b introduced by TALE nuclease pair BnFAD2_T03
caggatctatgggtgcaggtggaagaatgcaagtctctcctccctccagctcccccggaaccaacaccctcaaacgcgtcccctgcgagacaccaccattcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39122 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttctaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39123 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccatcaaacgcgtcccctccgagacaccacccttcactctgacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctagcgggcctctgggtcatagcccacgattgcggccaccacgccttcagcgactac

SEQ ID NO: 39124 - DNA, 369 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgaggcccacggcttgaccccggagcaggtggtggccatcgcctggcacgatggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39125 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgccccctgcgagacaccacccttcatcccacctcacttcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggccatagcccacgagtgcggccaccacgccttcagcgactac

SEQ ID NO: 39126 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtcataaaccgacaacatcaagcgcgtacccccagcaggtggtgaccatcgccagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 39127 - DNA, 338 bp, Artificial
  Mutation in BnaC.FAD2.b introduced by TALE nuclease pair BnFAD2_T03
caggatccatgggtgcaggtgaaagaatgcaagtctctcctccctccagctcccccgaaaccaaaaccctcaaacgcgtcccctgcgagacaccacccttcactaaagcaatcctacctcacttcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgccaacgaatgcggccaccacgccttcagcgactac

SEQ ID NO: 39128 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 39129 - DNA, 413 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccataccggccaccacctgctggggggtcaagccgtgggcctggcacagcaccggcaacagccgctggaccggagacctcaagaaagcaatcccacctcactgcttcaaacgctccatccctcgctccttctcctacctcctcttcgacatcctcgtctcctcctccctctaccacctcgccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 39130 - DNA, 335 bp, Artificial
  Mutation in BnaC.FAD2.b introduced by TALE nuclease pair BnFAD2_T03
caggatccatgggtgcagtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39131 - DNA, 322 bp, Artificial
  Mutation in BnaC.FAD2.b introduced by TALE nuclease pair BnFAD2_T03
caggatccatgggtgcaggtggaagaatgcaagtgtctcctccctccagctcgcccggaaccaacaccatcaagcgcgtcccctgcgagacaccacctcaagcaagcaatgccacctcactacttcaaacgccccaccgcacgcaacgtctcctctccggcatcatcatctcctcctcggcggcgccctctaccacctctcgacacccccctgccctctcccctacctcgcctggcccctctactgggcctgccaaggctgcgtcctaacgggcctctgggtcatcgcccacgaatgcggccaccacgccttcagcgactac

SEQ ID NO: 39132 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39133 - DNA, 281 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39134 - DNA, 379 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccacccttcactcttgaacgctctcctgagtaggacaaatccgctccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39135 - DNA, 356 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcggcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39136 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccacctcactgcttcaaacgctccatcccacgctacttctcctcttcgacatcatcatctcctcctcggctcctccctctaccacctctccacagcctacttccctctcccttacctcgcctgacccctctactgggcctgccaaggctgcgtccgaacgggcctctgggtcatagcccacgagtgcggccaccacgccttcagcgactac

SEQ ID NO: 39137 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacaggcctctgggtcatcgcccacgaatgcggccaccacgccttcagcgactac

SEQ ID NO: 39138 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39139 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccatcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 39140 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 39141 - DNA, 348 bp, Artificial
  Mutation in BnaC.FAD2.b introduced by TALE nuclease pair BnFAD2_T03
caggatccatgggtgcaggtagaagaatgcaagtctctcctccctccagctcccccgaaaccaaaaccctcaaacgcgtcccctgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggcctccacgccttcagcgactac

SEQ ID NO: 39142 - DNA, 357 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcctttttacggttcctctccctcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 39143 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctcgggagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39144 - DNA, 399 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcggatggcctttttgcgtttctacaaactcttcctggctagcggtactcggagacctcaagaaagcaatcccacctcactgcttcaaacgctccatccctcgctccttctcctacctcctcttcgacatcctcgtctcctcctcccgctaccacctctccacagcctacttccctctcctcccccaccctctcccttacctcgccgggcccctctactgggcctgccaaggctgcgtcctaacgggcctctgggtcatcgcccacgaatgcggccaccacgccttcagcgactac

SEQ ID NO: 39145 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcacctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgtgtgcggccaccacgccttcagcgactac

SEQ ID NO: 39146 - DNA, 353 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39147 - DNA, 329 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39148 - DNA, 411 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggaccggcgcacgcgctctggaggccttgctcacggtggcgggcgagttgagaggtccggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39149 - DNA, 369 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgaggcccacggcttgaccccggagcaggtggtggccatcgccagccacgatggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39150 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 39151 - DNA, 331 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39152 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactctgacctcaagaaagcaatcccacctcactgcttcaaacgctccatccctcgctccttctcctacctcctcttcgacatcctcgtctcctcctccctctaccacctctccacagcctacttccctctcctaccccacccgctcccttccctcacccgcacgctctaccagacctgccagggctgcgtccaagcgggcctctggatcatcgcccacggattcggccaccacgccttcagccactac

SEQ ID NO: 39153 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactacctcaagaaagcaatcccacctcactgcttcaaacgctccatccctcgccccttctcctacctcctctccgacaccctcgtctcctcctccctctcccacctctccacagcccacttccctctcccttacctcgcctgccccctctactgggcctgccaaggctgcgtcctaacgggcctctgggtcatagcccacgagtgcggccaccacgccttcagcgactac

SEQ ID NO: 39154 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaccgcgtcccctgcgagacaccaccattcactctcgggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctctgggtcatagcccacgagtgcggccaccacgccttcagcgactac

SEQ ID NO: 39155 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccctcaagaaagcaatcccacctcactgcttcaaacgctccatcccacgctccttctcctcttcgacatcatcatctcctcctcgcctcctccctctaccacctctccacagcctacttccctctcccttacctcgcctcacccctctactgggcctgccaaggctgcgtcctaacgggcctctgggtcatcgcccacgaatgcggccaccacgccttcagcgactac

SEQ ID NO: 39156 - DNA, 383 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgaggcccacggcttgaccccggagcaggtggtggccatcgccagccacgatggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39157 - DNA, 336 bp, Artificial
  Mutation in BnaC.FAD2.b introduced by TALE nuclease pair BnFAD2_T03
caggatccatgggtgcaggtagaagaatgcaagtctctcctccctcaagctcccccggaaccaacaccctcaaacgcgtcccctgcgagacaccaccattcactctagacctcaagaaagcagtcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 39158 - DNA, 411 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgccagcaataatggtggcaagcaggcgctggagacggtccagcggctgttgccggtgctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggtccctctactgggcctgccaaggctgcgtcctaacgggcctctgggtcatagcccacgagtgcggccaccacgccttcagcgactac

SEQ ID NO: 39159 - DNA, 338 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacacctcccttcactctcggagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39160 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgtcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 39161 - DNA, 318 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgagcccccgatttagagcttgacggggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39162 - DNA, 472 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcacgctcactgcccgctttccagtcgggaaacctgtcgtgccagctgcattaatgaatcggccaacgcgcggggagaggcgggttgtgtattgggggcccttccccttcctcccccactcactcgctgcgctcggagacctcaagaaagcaatcccacctcactgcttcaaacgccccagccctcgctccttctcctacctcctcttcgacatcatcacctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39163 - DNA, 295 bp, Artificial
  Mutation in BnaC.FAD2.b introduced by TALE nuclease pair BnFAD2_T03
caggatccatgggtgcaggtggaagaatgcaagtctctcctccccccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcagcgactac

SEQ ID NO: 39164 - DNA, 351 bp, Artificial
  Mutation in BnaC.FAD2.b introduced by TALE nuclease pair BnFAD2_T03
caggatccatgggtgcaggtggaagaatgtaagtctctcctccctccagctcccccgaaaccaaaaccctcaaacgcgtcccctgcgagacaccacccttcactctcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39165 - DNA, 351 bp, Artificial
  Mutation in BnaC.FAD2.b introduced by TALE nuclease pair BnFAD2_T03
caggatccatgggtgcaggtcgaagaatgcaagtccctcctccctccagctcccccgaaaccaaaaccctcaaacccgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggggtctgggtcatggcccacgagtgcggcgaccacgccttcagcgactac

SEQ ID NO: 39166 - DNA, 335 bp, Artificial
  Mutation in BnaC.FAD2.b introduced by TALE nuclease pair BnFAD2_T03
caggatccatgggtgcaggtggaagaatgcaagtctctcctccctccagctccccaggaaccaacaccctcaaacgcgtcccctgcgagacaccaccattcactcagacctcaagaaagcaatcccacctcactgcttcaaacgctccatcccacgctccttctcctcttcgacatcatcatctactcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39167 - DNA, 345 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgctcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39168 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccagagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggccatcgcccacgaatgcggccaccacgccttcagcgactac

SEQ ID NO: 39169 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 39170 - DNA, 336 bp, Artificial
  Mutation in BnaC.FAD2.b introduced by TALE nuclease pair BnFAD2_T03
caggatccatgggtgcaggtggaagaatgcaagtctctcatccctccagctcccccgaaaccaaaaccctcaaacgcgtcccctgcgagacaccacccttcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgaccactctactgggcctgccaaggctgcgtcctaacgggcctctgggtcatagcccacgagtgcggccaccacgccttcagcgactac

SEQ ID NO: 39171 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39172 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39173 - DNA, 347 bp, Artificial
  Mutation in BnaC.FAD2.b introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcacagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 39174 - DNA, 332 bp, Artificial
  Mutation in BnaC.FAD2.b introduced by TALE nuclease pair BnFAD2_T03
caggatccatgggtgcaggtcgaagaatgcaagtctatcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcctcctccaccctctcccttacctcgcctggcccctctactgggcctgccaaggctgcgtcctaacgggcctctgggtcatcgcccacgaatgcggccaccacgccttcagcgactac

SEQ ID NO: 39175 - DNA, 384 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttccccggagcaggtggtggccatcgccagcaatattggtggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 39176 - DNA, 378 bp, Artificial
  Mutation in BnaC.FAD2.b introduced by TALE nuclease pair BnFAD2_T03
caggatccatgggtgcaggtggaagaatccaagtccatcctccctccagctaccccggaccccacaccctcaaacgcgtcccctgcgagacaccaccattcactctcgcctgcttgccaccgccattgctggcgatggccaccacctttgacctcaagaaagcaatcccacctcactgcttcaaacgctccatcccacgctccttctcctcttcgacaccatcatctcctcctcggctcctccctctaccacgtccccacagcctactaccctcgcccttacctcgcctgacccctctactgggcctgccaaggctgcgtcctaacgcgcctctggggcatagcccacgagttctgcggccacgccatcagcgactac

SEQ ID NO: 39177 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccccctcactgcttcaaacgctccatcccccgctccttctcctacctcctcttcgacatcctcgtcgcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39178 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39179 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacttagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtactaacgggcctctgggtcatagcccacgagtgcggccaccacgccttcagcgactac

SEQ ID NO: 39180 - DNA, 351 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39181 - DNA, 286 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39182 - DNA, 336 bp, Artificial
  Mutation in BnaC.FAD2.b introduced by TALE nuclease pair BnFAD2_T03
caggatccatgggtgcaggtgcaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39183 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccatcaaacgcgtcccctgcgagacaccaccattcactgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtccgaacgggcctcggggtcatagcccacgagtgcggccaccacgccttcagcgactac

SEQ ID NO: 39184 - DNA, 370 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccgtccagcggctgttgccggtgttgtgcctggcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39185 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 39186 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaacaacaccctcaaacgcgtcccctgcgagacaccaccattcactcgacctcaagaaagcaatcccacctcactgcttcaaacgctccatcccacgctccttctcctacctcctcttcgacatcctcgtctcctcctccctctaccacctctccacagcctacttccctctcctcccccaccctctccctcacctcgcctggcccctctactgggcctgccaaggctgcgtcctaacgggcctctgggtcatcgcccacgaatgcggccaccacgccttcagcgactac

SEQ ID NO: 39187 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39188 - DNA, 411 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcagcggatttgtcctactcaggagagcgttcaccgacaaacaacagataaaacgaaaggcccagtcttccctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39189 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagccaacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39190 - DNA, 346 bp, Artificial
  Mutation in BnaC.FAD2.b introduced by TALE nuclease pair BnFAD2_T03
caggatccatgggtgcaggtggaagaatgcaagtctctcctccctccagcttccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 39191 - DNA, 331 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39192 - DNA, 401 bp, Artificial
  Mutation in BnaC.FAD2.b introduced by TALE nuclease pair BnFAD2_T03
caggatccatgggtgcaggttgaagaatgcaagtctctcctccctccagctcccccgaaaccaaaaccctcaaacgcgtcccctgcgagacaccaccattcactctcggggtcaagccgtgggcctggcacagcaccggcaacagccgctggaccgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39193 - DNA, 393 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcctgcttgcaaccgccattgctggcgatggccaccacctttgacctcaagaaagcaatcccacctcactgcttcaaacgctccatcccacgctccttctcctcttcgacatcatcatctcctcctcggctcctccctctaccacctctccacagcctacttccctctccgcccccaccctctcccttacctcgcctggcccctctactgggcctgccaaggctgcgtcctaacgggcctctgggtcatcgcccacgaatgcggccaccacgccttcagcgactac

SEQ ID NO: 39194 - DNA, 351 bp, Artificial
  Mutation in BnaC.FAD2.b introduced by TALE nuclease pair BnFAD2_T03
caggatccatgcgtgcaggtggaagaatgcaagtgtctcctccctccaagaagtctgaaaccgacaccatcaagcgcgtaccctgcgagacaccgcccttcactgtgagaactcaagaaagcaatcccaccgcactgtctcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39195 - DNA, 332 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaactcaagaaagcaatcccaccgcactgtttcaaacgctcgatccctcgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 39196 - DNA, 428 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttccagcgcctgcttgccaccattattgctggcgatggccaccacctgctgggggtcaagccgtgggcctggcacagcaccggcaacagccggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39197 - DNA, 415 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgatgggcaggttgtagccgccggagtaggccttggtgtccacgatcacgccgtagtcgatggggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39198 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagaccacaagaaaacaatcccacctcactgcttcaaacactccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39199 - DNA, 348 bp, Artificial
  Mutation in BnaC.FAD2.b introduced by TALE nuclease pair BnFAD2_T03
caggatccatgggtgcaggtcgaagaatgcaagtctctcctccctccagctcccccggaaccaacaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39200 - DNA, 343 bp, Artificial
  Mutation in BnaC.FAD2.b introduced by TALE nuclease pair BnFAD2_T03
caggatccatgggtgcaggtggaagaatgcaagtctctcctccctccagctccccggaaccaacaccctcaaacgcgtcccctgcgagacaccaccattagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39201 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctgacccctctactgggcctgccaaggctgcgtcccaacgggcctctgggtcatagcccacgagtgcggccaccacgccttcagcgactac

SEQ ID NO: 39202 - DNA, 369 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgaggcccacggcttgaccccggagcaggtggtggccatcgcctggcacgatggagacctcatgaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39203 - DNA, 273 bp, Artificial
  Mutation in BnaC.FAD2.b introduced by TALE nuclease pair BnFAD2_T03
caggatccatgggtgcaggtggaagaatgcaagtctcgacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39204 - DNA, 345 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcctctgggtcatagcccacgagtgcggccaccacgccatcagcgactac

SEQ ID NO: 39205 - DNA, 452 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggcgtcctgcccgccaccctccgggccgttgcttcacaacgttcaaatccgctcccggcggatttgtcctactcaggagagcgttcaccgacaaacaacagataaaacgaaaggcccagtcttccactgcttcaaacgctccatcccacgctccttctcctcttcgacatcatcatctccgccacggctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 39206 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 39207 - DNA, 416 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttaggctccgcccccctgacgagcatcacaaaaatcgacgctcatccagcgcctgttgccggtgctgtgccaggcccacggagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 39208 - DNA, 321 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctccatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39209 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgagtgcggccaccacgccttcagcgactac

SEQ ID NO: 39210 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 39211 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcaagaaagcaatcccacctcactgcttcaaacgctccatcccacgccccttctccccttcgacctcatcatctcctcctcggctcctccctctaccacctctccacagcctacttccctctcctccccccccctctccctttcctcgcctggcccctctactgggcctgccaaggctgcgtcctaacgggcctctgggtcatcgcccacgaatgcggccaccacgccttcagcgactac

SEQ ID NO: 39212 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgcaaccaacaccctcaaacgcgtcccctgcgagacaccaccattcactctcggtcggagacctcaagaaagcaatcccacctcactgcttcaaacgctccatcccacgctccttctcctcttcgacatcatcatctcctcctcggctcctccctctaccacctctccacagcctacttccctcgcccttacctcgcctgacccctctactgggcctgccaaggctgcgtcctaacgggcctctgggtcatagcccacgagtgcggccaccacgccttcagcgactac

SEQ ID NO: 39213 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctatgggtcatagcccacgagtgcggccaccacgccttcagcgactac

SEQ ID NO: 39214 - DNA, 337 bp, Artificial
  Mutation in BnaC.FAD2.b introduced by TALE nuclease pair BnFAD2_T03
caggatccatgggtgcaggtcgaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39215 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcggagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgacta

SEQ ID NO: 39216 - DNA, 335 bp, Artificial
  Mutation in BnaC.FAD2.b introduced by TALE nuclease pair BnFAD2_T03
caggatccatgggtgcaggtgcaagaatgcaagtctctcctccctcccgctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39217 - DNA, 336 bp, Artificial
  Mutation in BnaC.FAD2.b introduced by TALE nuclease pair BnFAD2_T03
caggatccatgggtgcaggtagaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39218 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgagaactcaagaaagcaatcccaccgcactgtttcaaacgctcgatccctcgctccttctcctacctcctcttcgacatcctcgtctcctcctccctctaccacctctccacagcctacttccctctcctcccccacactctcccttacctcgcctggcccctctactgggcctgccaaggctgcgtcctaacgggcctctgggtcatcgcccacgaatgcggccaccacgccttcagcgactac

SEQ ID NO: 39219 - DNA, 364 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttttggagcagcaacgatgttacgcagcaggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39220 - DNA, 347 bp, Artificial
  Mutation in BnaC.FAD2.b introduced by TALE nuclease pair BnFAD2_T03
caggatccatgagtgcaggtggaagaatccaagtctatcctccctccagctcccccggaaccaacaccctcaaacgcgtcccctgcgagacaccaccattcactaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgccctcgaattcggccaccgcgccatcagcgactac

SEQ ID NO: 39221 - DNA, 433 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctaggcgccttatccggtaactatcgtcttgagtccaacccggtaagacacgacttatcgccactggcagcagccactggtaacaggattagcagagcgaggtatgtagaaagcaatcccacctcactgcttcaaacgctccatccctcgctccttctcctcttcgacatcatcatctcctcctcgtctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39222 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgtgtcctaacgggcctctgggtcatcgcccacgaatgcggccaccacgccttcagcgactac

SEQ ID NO: 39223 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcacccctcaagaaagcaatcccacctcactgcttcaaacgctccatccctcgctccttctcctcttcgacatcatcatctcctcctcggctcctccctctaccacctctccacagcctacttccctctcccttacctcgcctgacccctctacagggcctgccaaggctgcgtcctaacgggcctctgggtcatcgcccacgaatgcggccaccacgccttcagcgactac

SEQ ID NO: 39224 - DNA, 331 bp, Artificial
  Mutation in BnaC.FAD2.b introduced by TALE nuclease pair BnFAD2_T03
caggatccatgggtgcaggcggaagaatgcaagtgtctcctccctccaagaagtctgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39225 - DNA, 412 bp, Artificial
  Mutation in BnaC.FAD2.b introduced by TALE nuclease pair BnFAD2_T03
caggatccatgggtgcaggaggaagaatgcaagtcactcatccctccagctcccccgaaaccaaaaccctcaaacgcgtcccctgcgagacatcaccattcaatctcggctgttgccggtgctgtgccaggcccacggcttgaccccggagcaggtggtggccatcggagacctcaagaaagcaatcccacctcactgcttcaaacgctccatccctcgctccttctcctacctcctcttcgacatcctcgtctcctcctccctctaccacctctccacagcctacgtccctctcctcccccaccctctcccttacctcgcctggcccctctactgggcctgccaaggctgcttcctaacgggcctctgggtcatcgcccacgaattcggccaccacgccatcagcgactac

SEQ ID NO: 39226 - DNA, 380 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtgccaggcccacggcttgaccccccagcaggtggtggccagagacctcaagaaagcaatcccacctcactgcttcaaacgctccatcccacgctccttctcctcttcgacatcatcatctcctcctcggctcctccctctaccacctctccacagcctcctaccctctcccttacctcgcctgacccctctactgggcctgccaaggctgcttcctaacgggcctctgggtcatcgcccacgaatgcggccaccacgccatcagcgactac

SEQ ID NO: 39227 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcatgacccctctactgggcctgccaaggctgcgtcctaacgggcctctgggtcatagcccacgagtgcggccaccacgccttcagcgactac

SEQ ID NO: 39228 - DNA, 403 bp, Artificial
  Mutation in BnaC.FAD2.b introduced by TALE nuclease pair BnFAD2_T03
caggatccatgggtgcaggtggaagaatgtaagtctctcctccctccagctcccccggaaccaacaccctcaaacgcgtcccctgcgagacaccaccattcactagtcctgtcgggtttcgccacctctgacttgagcgtcgatttttgtgatgctcggagacctcaagaaagcaatcccacctcactgcttcaaacgctccatccctcgctccttctcctacctcctcttcgacatcctcgtctcctcctccctctaccacctctccacagcctacttccctctcctcccccaccctcgcccttacctcgcctggcccctctactgggcctgccaaggctgcgtcctaacgggcctctgggtcatcgcccacgaatgctgccaccacgccttcagcgactac

SEQ ID NO: 39229 - DNA, 370 bp, Artificial
  Mutation in BnaC.FAD2.b introduced by TALE nuclease pair BnFAD2_T03
caggatccatgggtgcaggtcgaagaatgcaagtctctcctccctccagctcccccggaaccaacaccctcaaacgcgtcccctgcgagacaccaccattcactccgtccagcggctgttgccggtgttgtgcctggcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 39230 - DNA, 355 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 39231 - DNA, 331 bp, Artificial
  Mutation in BnaC.FAD2.b introduced by TALE nuclease pair BnFAD2_T03
caggatccatgggtgcaggtggaagaatgcaagtctctcctcccccccgctcccccgaaaccaaaaccctcaaccgcgtcccctgcgagacaccacccttcactctcggcttcactgcttcaaacgctccacccctcgctccttctcctacctcctcttcgacatcctcatctcctcctccctctaccacctctccacagcctacttccctctcctcccccaccctctcccttacctcgcctggcccctctactgggcctgccaaggctgcttcctaacgggcttctgggtcatcgcgcaccaatgcggccaccacgccttcatcgactac

SEQ ID NO: 39232 - DNA, 337 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactctgagacctcaagaaagcaatccaacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39233 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgtgcctctgggtcatcgcccacgaatgcggccaccacgccttcagcgactac

SEQ ID NO: 39234 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcagaccccaagaaagcaatcccacctcactgcttcaaacgctccatcccacgctccttctcctcttcgacatcatcagcccctcctcggctcctccctctaccacctctccacagcctacttccctctcccttacctcgcctgacccctctactgggcctgccaagactgcgtcctaacgggcctctgggtcatagcccacgagtgcggccaccacgccttcagcgactac

SEQ ID NO: 39235 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgtgcctgccaaggctgcgtcctaacgggcctctgggtcatcgcccacgaatgcggccaccacgccttcagcgactac

SEQ ID NO: 39236 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39237 - DNA, 349 bp, Artificial
  Mutation in BnaC.FAD2.b introduced by TALE nuclease pair BnFAD2_T03
caggatccatgggtgcaggtcgaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcctccaccctctcccttgcctcgcctggcccctctactgggcctgccaaggctgcgtcctaacgggcctctgggtcatcgcccacgaatgcgaccaccacgccttcagcgactac

SEQ ID NO: 39238 - DNA, 290 bp, Artificial
  Mutation in BnaC.FAD2.b introduced by TALE nuclease pair BnFAD2_T03
caggatccatgggtgcaggtggaagaatgcaagtgtctccttcctccaaaaagtctgaaaccgacaacatcaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39239 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39240 - DNA, 306 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgtgtcctaaccggcgtctgggtcatagcccacgagtgcggccaccacgccttcagcgactac

SEQ ID NO: 39241 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggagaactcaagaaagcaatcccacctcactgcttcaaacgctccatccctcgctccttctcctacctcctcttcgacatcatcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 39242 - DNA, 406 bp, Artificial
  Mutation in BnaC.FAD2.b introduced by TALE nuclease pair BnFAD2_T03
caggatcctgggtgcaggtggcagaatgcaagtctctcctccctccagctcccccggaaccaacaccctcaaacgcgtcccctgcgagacaccaccattcactcttccagcgcctgcttgccaccattattgctggcgatggccaccacctgctggggggtcaagccgtgggcctggcacagcaccggcaacagccggagacctcaagaaagcaatcccacctcactgcttcaaacgctccatcccacgctccttctcctcttcgacatcatcatctcctcctcggctcctccctcaccctctctcctacttcgcctggcctctctactgggcctgccagggctgcgtcctaaccggcgtctgggtcatagcccacgagtgcggccaccacgccttcagcgactac

SEQ ID NO: 39243 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 39244 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39245 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39246 - DNA, 377 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccgtccagcggctgttgccggtgttgtgcctggcggagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39247 - DNA, 333 bp, Artificial
  Mutation in BnaC.FAD2.b introduced by TALE nuclease pair BnFAD2_T03
caggatccatgggtgcaggtgcaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39248 - DNA, 335 bp, Artificial
  Mutation in BnaC.FAD2.b introduced by TALE nuclease pair BnFAD2_T03
caggatccatgggtgcaggtgaaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctcatcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39249 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 39250 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaaccctccatcccccaccccttctcctacctcctcttcgacatcctcgtctcctcctccctctaccacctctccacagcctacttccctctcctccctcaccctctctcctgcgtcgcctggcccccctcctggggctgccaaggctgcgtcctaaccggcctctgggtaatatcccacgagtgcggcccccacgccctcagcgactacc

SEQ ID NO: 39251 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccacctcactgcttcaaacgctccatcccacgctccttctcctacctcctcttcgacatcctcgtcccctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 39252 - DNA, 377 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtccccctgcgagacaccacaccgcccgccataaactgccaggcatcaaacagcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39253 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaggcgctggagacctcaagaaagcaatcccacctcactgcttcaaacgctccatcccacgctccttctcctcttcgacatcatcatctcctcctcggatcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39254 - DNA, 348 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaactctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39255 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatagcccacgagtgcggccaccacgccttcagcgactac

SEQ ID NO: 39256 - DNA, 346 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaccgcgtcccctgcgagacaccacccttcacgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39257 - DNA, 354 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcagcccccaagaaaacaaccccccttaactgcttcaacccccccatcccccgctccttctcctacctcctctaccacatcctcttcgcctcctccctctaccacctctccacagcctacttccctctcccctcccaccctctcccttacctcgcctggcccctctactgggcctgccaaggctgcgtcctaaccggcctctgggtcatagcccacgagtgcggccaccacgccttcagcgactac

SEQ ID NO: 39258 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctccccttcgacatcctcgtctcctcctccctctaccacccctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 39259 - DNA, 279 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttcgacatcctcgtctcctcctccctctaccacctctccacagcctacttccctctcctcccccaccctctcccttccctcgcctggcccctctactgggcctgccaagggtgcgtcctaacgggcctctgggtcatagcccacgagtgcggccaccacgccttcagcgactac

SEQ ID NO: 39260 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcccctggcccctctactgggcctgccaaggctgcgtcctaacgggcctctgggtcatagcccacgagtgcggccaccacgccttcagcgactac

SEQ ID NO: 39261 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctcaccacagcctacttccctctcccttacctcgcctgacccttctactgggcctgccaaggctgcgtcctaacgggcctctgggtcatagcccacgagtgcggccaccacgccttcagcgactac

SEQ ID NO: 39262 - DNA, 414 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactggcacagcaccggcaacagccgctggaccgtcaggatggccttctgcttagtttgatgcctggcagtttatggcgggcaggaacctcaacaaagcaatcccacctcactgcttcaaacgctccatcccacgctccttctcctcttcgacatcatcacctcctcctcggctcctccccctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39263 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagaccccaagaaagcaatcccacctccctgcttcaaacgctccatccctcgctccttctcctacctcctcttcgacatcctcgtctcctcctccctctaccacccctccacagcctacttccctctcctccccccccctctcccttacctcgcctggcccctctactgggcctgccaaggctgcgtcctaacgggcctctgggtcagagcccacgagtgcggccaccacgccttcagcgactac

SEQ ID NO: 39264 - DNA, 399 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcggatggcctttttgcgtttctacaaactcttcctggctagcggtactcggagacctcaagaaagcaatcccacctcactgcttcaaacgctccatccctcgctccttctcctacctcctcttcgacatcctcgtctcctcctccttctaccacctcgccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39265 - DNA, 361 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgaggcccacggcttgaccccggagcaggtggtggccatcgccagccacgatggagacctcaagaaagcaatcccacctcactgcttcaaacgctccatcccacgctccttctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39266 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccccgcgagacaccacccttcacccctcaagaaagcaatcccacctcactgcttcaaacgctccatccctcgctccttctcctacctcctcttcgacatcctcgtctcctcctccctctaccacctctccacagcctacttccctctcctcccccgccctctccctttcctcgcctggcccctctactgggcctgccaaggctgcgtcctaacgggcctctgggtcatcgcccacgaatgcggccaccacgccttcagcgactac

SEQ ID NO: 39267 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttagacctcaagaaagcaatcccacctcactgcttcaaacgctccatcccacgctccttctcctcttcgacatcatcatctcctcctcggctcctccctctaccacctctccacagcctacttccctcgcctcccccaccctctcccttacctcgcctgacccctctactgggcctgccaaggctgcgtcctaacgggcctctgggtcatagcccacgagtgcggccaccacgccttccagcgactac

SEQ ID NO: 39268 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 39269 - DNA, 338 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccaccattcacttcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39270 - DNA, 327 bp, Artificial
  Mutation in BnaC.FAD2.b introduced by TALE nuclease pair BnFAD2_T03
caggatccatgggtgcaggtgaaagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccagggctgcgtcctaacgggcctctgggtcatcgcccacgaatgcggccaccacgccttcagcgactac

SEQ ID NO: 39271 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccatcaaacgcgtcccctgcgagacaccaccattcactctgacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39272 - DNA, 382 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgtggccatcgccagcaatggcggtggcaagcaggcgctggagacggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39273 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 39274 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagtcctgtcgggtttcgccacctctgacttgagcgtcgatttttgtgatgctcggagacctcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgtgcctctgggtcatagcccacgagtgcggccaccacgccttcagcgactac

SEQ ID NO: 39275 - DNA, 349 bp, Artificial
  Mutation in BnaC.FAD2.b introduced by TALE nuclease pair BnFAD2_T03
caggatccatgggtgcaggtagaagaatgcaagtctctcctccctccagctcccccgaaaccaaaaccctcaaacgcgtcccctgcgagacaccacccttcactcttacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39276 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaacgggcctctgggtcatagcccacgagtgcggccaccacgccttcagcgactac

SEQ ID NO: 39277 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcccaacgggcctctgagtcatagcccacgagtgcggccaccacgccttcagcgactac

SEQ ID NO: 39278 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 39279 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctacacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39280 - DNA, 382 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgccgatggccaccaccattcactcggggggtcaagccgtgggcccggcacagcaccggcaacagccgcagacctcaagaaagcaatcccacctcactgcttcaaacgctccatcccacgccccttctccccttcgacatcatcatctcctccccggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39281 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcacaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39282 - DNA, 347 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagagaactcaagaaagcaatcccacctcactgcttcaaacgctccatcccacgctccttctcctacctcctcttcgacatcctcgtctcctcctccctctaccacctctcaacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39283 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39284 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgaacctcaagaaagcaatcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 39285 - DNA, 329 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39286 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 39287 - DNA, 388 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctgttgccggtgctgtgccaggcccacggcttgaccccccagcaggtggagacctcaagaaagcaatcccacctcactgcttcaaacgctccatcccacgctccttctcctcttcgacatcatcatctcctcctcggctcctccctctaccacctctccacagcctccttcccgctcccttgcctcgcctgacccctctactgggcctgccaaggctgcgtccgaacgggcctctggggcatagcccacgagtgcggccaccacgccttcagcgactac

SEQ ID NO: 39288 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctacctcaagaaagcaatcccacctcactgcttcaaacgctccatccctcgctccttctcctacctcctcttcgacatcctcgtctcctcctccctctaccacctctccacagcccacttccctcccctcccccaccctctcccttccctcgcctggcccctctactgggcctgccaaggctgcgtccgaacgggcctctgggtcatcgcccacgaatgcggccaccacgccatcagcgactac

SEQ ID NO: 39289 - DNA, 321 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccataaaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39290 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactgagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggccgcttcctaacgggcctcggggtcatcgcccacgaatgcggccaccacgccttcagcgactac

SEQ ID NO: 39291 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttgcctcgcctgacccctctactgggcctgccaaggctgcgtcctaacgggcctcggggtcatagcccacgagtgcggccaccacgccatcagcgactac

SEQ ID NO: 39292 - DNA, 351 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39293 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgtggccaccacgccttcagcgactac

SEQ ID NO: 39294 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccctgaaaccaacaccctcaaacgcgtcccctgcgagacaccacccttcactcagacctcaagaaagcaatcccacctcactccttcaaacgctccatccctcgctccttctcctacctcctcttcgacatcctcgtctcctcctccctctaccacctctccacagcctacttccctctcctcccccaccctcccccttacctcgcctggcccctctactgggcctgccaaggctgcgtcctaaccggcgtctgggtcatagcccacgagtgcggccaccacgccttcagcgactac

SEQ ID NO: 39295 - DNA, 351 bp, Artificial
  Mutation in BnaC.FAD2.b introduced by TALE nuclease pair BnFAD2_T03
caggatccatgggtgcaggtgaaagaatgcaagtgtatcctccctccaaaaagtctgaaaccgacaacatcaagcgcgtaccctgcgagacaccgcccttcactgtgagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcaacgcccacgaatgcggccaccacgccttcaacgactac

SEQ ID NO: 39296 - DNA, 337 bp, Artificial
  Mutation in BnaC.FAD2.b introduced by TALE nuclease pair BnFAD2_T03
caggatccatgggtgcaggtggaataatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcaactcctcctcggctcctccctctaccacctctccacagcctacttccctctcccttacctcgcctgacccctctactgggcctgccaaggctgcgtcctaacgggcctctgggtcatagcccacgagtgcggccacctcgccttcagcgactac

SEQ ID NO: 39297 - DNA, 420 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactctcggagttgtcccgaacccaatccttccccactgctccaaaggcggcaatccccacccccgctcccggcaacagccgctggacccagacctcaacaaagcaatcccacctcactgcttcaaacgctccatcccacgctccttctcctctccgccaccaccacctcctcctcggctcctccccctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 39298 - DNA, 348 bp, Artificial
  Mutation in BnaC.FAD2.b introduced by TALE nuclease pair BnFAD2_T03
caggatccatgggtgcaggtggaagaatgcaagtgtgtcctccctccaaaaagtctgaaaccgacaacatcaagcgcgtaccctgcgagacaccgcccttcactgtaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39299 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctccccacagcctacttccctctcccttacctcgcctgacccctctactgggcctgccaaggctgcgtcctaacgggcctctgggtcatagcccacgagtgcggccaccacgccttcagcgactac

SEQ ID NO: 39300 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39301 - DNA, 381 bp, Artificial
  Mutation in BnaC.FAD2.b introduced by TALE nuclease pair BnFAD2_T03
caggatccatgggtgcaggtggaagaatgcaagtctctcctccctccagctccccggaaccaacaccctcaaacgcgtcccctggcgatggccaccaccattcactcggggggtcaagccgtgggcctggcacagcaccggcaacagccgcagacctcaagaaagcaatcccacctcactgcttcaaacgctccatcccacgctccttctcctcttcgacatcatcatctcctcctcggctcctccctctcccacctctccccagcctccttccctctcccttacctcgcctgacccctctactgggcctgccaaggctgcgtcctaacgggcctctgggtcatagcccacgagtgcggccaccacgccttcagcgactac

SEQ ID NO: 39302 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctctttctcctacctcatctgggacatcatcatagcctcctgcttctactacgtcgccaccacttacttccctctcctccctcaccctctcccttaccccgcctggcccctctactgggcctgccaaggctgcgtcctaacgggcctctgggtcatcgcccacgaatgcggccaccacgccttcagcgctac

SEQ ID NO: 39303 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactacctcaagaaagcaatcccacctcactgcttcaaacgctccatcccacgctccttctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39304 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccatcagcgactac

SEQ ID NO: 39305 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatccctcgctccttctcctacctcctcttcgacatcctcgtctcctcctacctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 39306 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39307 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgacctcaagaaagcaatcccacctcactgcttcaaacgctccatcccactctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39308 - DNA, 384 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtggataaccgtattaccgcctttgagtgagctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39309 - DNA, 386 bp, Artificial
  Mutation in BnaC.FAD2.b introduced by TALE nuclease pair BnFAD2_T03
caggatccatggttgcaggtggaagaatgcaagtctctcctccctccagctcccccggaaccaacaccctcaaacgcgtcccctgcgagacaccaccattcactctcggggtcaagccgtgggcctggcacagcaccggcaacagccgctggaccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39310 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccgaggctgcgtcctaacgggcctctgggtcatcgcccacgaatgcggccaccacgccttcagcgactac

SEQ ID NO: 39311 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaacaaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39312 - DNA, 332 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggcctccacgccttcagcgactac

SEQ ID NO: 39313 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39314 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacttggcctgccaaggctgcgtcctaacgggcctctgggtcatagcccacgagtgcggccaccacgccttcagcgactac

SEQ ID NO: 39315 - DNA, 410 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctacaggcccacggcttgaccccccagcaggtggtggccatcgccagcaataatggtggcggagacctcaagaaagcaatcccacctcactgcttcaaacgctccatccctcgctccttctcctacctcctcttcgacatcctcgtcccctccaccctctaccacctctccacagcctacttccctcgcctcccccaccctctcccttacctcgcctggcccctctactgggcctgccaaggctgcgtcctaacgggcctctgggtcatcgcccacgaatgcggccaccacgccttcaacgactac

SEQ ID NO: 39316 - DNA, 416 bp, Artificial
  Mutation in BnaC.FAD2.b introduced by TALE nuclease pair BnFAD2_T03
caggatccatgggtgcaggtggaagaatgcaagcctctcctccctccagctcccccggaaccaacaccttcaaatgcgtcccctgcgagacatcaccattcactctagcgcctgctgccgctgctgtgccaggcccacggcttgaccccccagcagctggtggccatcgccagcaataatggtggcagaccacaagaaagcaatcccacctcactgcttcaaacgctccatcccacgctccttctcctctgcgacatcttccccccctcctcggctcctccctctaccacctctccacagcctacttccctctcccttacctcgcctgacccctctacagggcctgccagggctgcgtcctaacgggcctctgggtcatagcccacgagtgcggccaccacgccatcagcgactcc

SEQ ID NO: 39317 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctattcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39318 - DNA, 348 bp, Artificial
  Mutation in BnaC.FAD2.b introduced by TALE nuclease pair BnFAD2_T03
caggatccatgggtgcaggtagaagaatgcaagtctctcctccctccagctcccccgaaaccaaaaccctcaaacgcgtcccctgcgagacaccacccttcactctacctcaagaaagcaatcccacctcactgcttcaaacgctccatccctcgctccttctcctacctcctcttcaacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39319 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccgacgtctgggtcatagcccacgagtgcggccaccacgccttcagcgactac

SEQ ID NO: 39320 - DNA, 410 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgcgtagattttcaggtttaacgtcagatgaatatacagtcacagtacccttaacatcagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 39321 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgacctcaagaaagcaatcccacctcactgcttcaaaccctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39322 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 39323 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttacagcgagcgatcccacctcactgcttcaaacgctccatcccacgctccttctcctcttcgacatcatcgtctcctcctccctctaacacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39324 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagctactac

SEQ ID NO: 39325 - DNA, 349 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39326 - DNA, 334 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctggctcatagcccacgagtgcggccaccacgccttcagcaactac

SEQ ID NO: 39327 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgaaaccatcaagcgcgtaccctgcgagacaccgcccttcactgaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39328 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctctgggtcatagcccacgagtgcggccaccacgccttcagcgactac

SEQ ID NO: 39329 - DNA, 356 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcgctctcgggggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39330 - DNA, 357 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcatcatctcctcctcggctcctccctctaccccctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39331 - DNA, 406 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaaagactgggcctttcgttttatctgttgtttgtcggtgaacgctctcccgagtaggacaaatccgccggagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39332 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttagccctcaagaaagcaatcccacctcactgcttcaaacgctccatccctcgctccttcccctacctcctcttcgtcatcctcgactcctcctccctctaccacctctccaccgcctacttccctctcctcccccaccctctcccttacctcgcctggcccctctactgggcctgccaaggctgcgtcctaaccggcgtctgggtcattgcccacgagtgcggccaccacgccttcagcgactac

SEQ ID NO: 39333 - DNA, 279 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 39334 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccatcagcgactac

SEQ ID NO: 39335 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39336 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtccgaacgggcctctgggtcatcgcccacgaatgctgccaccacgccttcagcgactac

SEQ ID NO: 39337 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39338 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgagacctcaagaaagcaatcccacctcactgcttcaaacgctccatcccacgctccttctcctcttcgacatcatcatctcctcctcgcctcctccctctaccacctctccacagcctacttccctctcctcccccaccctctcccttacctcgcctggcccctctactgggcctgccaaggctgcgtcctaacgggcctctgggtcatcgcccactaatgcggccaccacgccttcagcgactac

SEQ ID NO: 39339 - DNA, 331 bp, Artificial
  Mutation in BnaC.FAD2.b introduced by TALE nuclease pair BnFAD2_T03
caggatccatgggtgcagggggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 39340 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 39341 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaactcctccctcggagacctcaagaaagcaatcccacctcactgcttcaaacgctccatcccacgctccttctcctcttcgacatcctcgtctcctcctccctctaccacctctccacagcctacttccctctcctcccccaccctctcccttccctcgcctggcccctctactgggcctgccaagggtgcgtcctaacgggcctctgggtcatagcccacgagtgcggccaccacgccttcagcgactac

SEQ ID NO: 39342 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgccatcctcgtctcctcctccctctaccacctctccacagcctacttccctctcctcccccaccctctcccgtgcctcgcctatcccctctactgggccttccacggctgcttcctaacgggcctctgcctcatagcccacgagtgctgccaccacgccatcagcgactac

SEQ ID NO: 39343 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggccggccaaggctgcgtcctaacgggcctctgggtcatagcccacgagtgcggccaccacgccttcagcgactac

SEQ ID NO: 39344 - DNA, 336 bp, Artificial
  Mutation in BnaC.FAD2.b introduced by TALE nuclease pair BnFAD2_T03
caggatccatgggtgcaggtggaagaatgcaagtatctcctccctccagctcccccgaaaccaaaaccctcaaacgcgtcccctgcgagacaccacccttcactctagacctcaagaaagcaatcccacctcactgcttcaaacgctccatccctccctccttctcctcttcgacatcatcatctcctcctcggctcctccctctaccacctctccacagcctacttccctctcccttacctcgcctgacccctctactgggcctgccaaggctgcgtcctaacgcgcctctgggtcataggccacgagtgcggcgaccacgccaacagcgactgc

SEQ ID NO: 39345 - DNA, 334 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39346 - DNA, 418 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgcgagacaccaccatgcaagtctctcctccctccagctcccccggaaccaacaccctcaaacgcgtcccctgcgagacaccaccacctcaagaaagcaatcccacctcactgcttcacacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39347 - DNA, 332 bp, Artificial
  Mutation in BnaC.FAD2.b introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcacgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39348 - DNA, 337 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39349 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagcgcggccaccacgccttcagcgactac

SEQ ID NO: 39350 - DNA, 417 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctgttgccggtgctgtgccatgcccacggcttgaccccggagcaggtggtggccatcgccagccacgatggcggcaagagacctcaagaaagcaatcccacctcactgcttcaaacgctccatcccacgctccttctccccttcgacttcatcatctcctcctcggctcctccctctaccacctctccacagcctacttccctctcccttacctcgcctgacccctctaccgggcctgccaaggctgcgtcctaacgggcctctgggtcatagcccacgagtgcggccaccacgccttcagcgactac

SEQ ID NO: 39351 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccatcacgccttcagcgactac

SEQ ID NO: 39352 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtccactgcgagacaccaccattcactctaagacctcaagaaagcaatcccacctcactgcttcaaacgctccatcccacgctccttctcctcttcgacatcatcacctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39353 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 39354 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39355 - DNA, 368 bp, Artificial
  Mutation in BnaC.FAD2.b introduced by TALE nuclease pair BnFAD2_T03
caggatccatgggtgcaggtgaaagaatgcaagtgtctcctccctccaagaagtctgaaaccgacaccatcaagcgcgtaccctgcgagacaccgcccttcactgtagcaatggcggtggctggagaactcaagaaagcaatcccaccgcactggttcaaacgctcgatccctcgctctttctcctacctcatcttcgccatcctcgtctcctccaccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 39356 - DNA, 345 bp, Artificial
  Mutation in BnaC.FAD2.b introduced by TALE nuclease pair BnFAD2_T03
caggatccatgggtgcaggtggaagaatgcaagtatctcctccctccagctcccccgaaaccaaaaccctcaaacgcgtcccctgcgagacaccacccttcactctcgagacctcaagaaagcaatcccacctcactgcttcaaacgctccatccctcgctccttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39357 - DNA, 339 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaagaactcaagaaagcaatcccaccgcactgtttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 39358 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctaactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcattcagcgactac

SEQ ID NO: 39359 - DNA, 327 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccaagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39360 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcacgactac

SEQ ID NO: 39361 - DNA, 342 bp, Artificial
  Mutation in BnaC.FAD2.b introduced by TALE nuclease pair BnFAD2_T03
caggatccatgggtgcaggtggaagaatgcaagtgtctcctccctccaaaagtctgaaaccgacaacatcaagcgcgtaccctgcgagacaccgccctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39362 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39363 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39364 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39365 - DNA, 277 bp, Artificial
  Mutation in BnaC.FAD2.b introduced by TALE nuclease pair BnFAD2_T03
caggatccatgggtgcaggtggaagaatgcaagtctcctccctccaccgcccccgaaacccaaaccctcaaacacgtcccctgcgagacaccacccttcacactccgacatactcgcctcctcccccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39366 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggtccctctactgggcctgccaaggctgcgtcctaacgggcctctgggtcatcgcccacgaatgcggccaccacgccttcagcgactac

SEQ ID NO: 39367 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctgacccctctactgggcctgccaaggctgcgtcctaacgggcctctgggtcatagcccacgagtgcggccaccacgccttcagcgactac

SEQ ID NO: 39368 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgaacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39369 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgtcaaggctgcgtcctaacgggcctctgggtcatagcccacgagtgcggccaccacgccttcagcgactac

SEQ ID NO: 39370 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactat

SEQ ID NO: 39371 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggagcaggtggtggccatcgccagcaatattggtggcaagcaggcgctggagacggtgcgagacctcaagaaagcaatcccacctcactgcttcaaacgctccatccctcgctccttctcctacctcctcttcgacatcctcgtctcctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39372 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccaccccccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39373 - DNA, 434 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggaccgtctccagcgcctgcttgccaccgccattgctggcgatggccaccacctgctggggggtcaagccgtgggcctggcggagacctcaagaaagcaatcccacctcactgcttcaaacgctccatccctcgctccttctcctacctcctcttcgccatcctcgtctcctccaccctctaccacctctccacagcctacttccctctcctccccccccctctcccttacctcgcctggcccctctactgggcctgccaaggctgcgtcctaacgggcctctgggtcatagcccacgagtgcggccaccacgccttcagcgactac

SEQ ID NO: 39374 - DNA, 426 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggggagaaaggcggacaggtatccggtaagcggcagggtcggaacagccgctggaccgtctccagcgcctgcttgccaccattattgctggccctcaagaaagcaatcccacatcactgcttcaaacgctccatcccacgctcctactcctcttcgacatcatcatcccctccccggctcctccctctaccccctctccacagcctacttccctctccctcacctcgcctgacccctcgactgggcctgccaaggctgcgtcctaacgggcctctgggtcatagcccacgagtgcggccaccacgccttcagcgactac

SEQ ID NO: 39375 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactc

SEQ ID NO: 39376 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 39377 - DNA, 431 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctgttgccggtgctgtgccaggcccacggcttgaccccggagcaggtggtggccatcgccagccacgatggcggcaagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39378 - DNA, 406 bp, Artificial
  Mutation in BnaC.FAD2.b introduced by TALE nuclease pair BnFAD2_T03
caggatccatgggtgcaggtcgaagaatgcaagtgtctcctccctccaagaagtctgaaaccgacaccatcaagcgcgtaccctgcgagacaccgcccttcggagccgcttgccgccattgctggcgatggccaccacctgctggggggtcaagccgtgggtagaactcaagaaagcaatcccaccgcactgtttcaaacgctcgatccctcgctctttctcctacctcctcttcgacatcctcgtctcctcctcccactaccacctctccacagcctacttccctctcctcccccaccctctcccttacctcgcctggcccctctactgggcctgcgaaggctgcgtcctaacgggcctctgggtcatcgcccacgagtggggccaccgcgccttcagcgactac

SEQ ID NO: 39379 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39380 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 39381 - DNA, 335 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39382 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39383 - DNA, 397 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactactgacagaaccgcaacgttgaaggagccactcagccgcgggtttctgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39384 - DNA, 444 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgtgggcctggcacagcaccggcaacagcgcctgcaccgtctccagcgctggtttgccaccaatattgctggcgatggccaccacctgctacgtagaactcaagaaagcaatcccacctcactgcttcaaacgctccatccctcgctccttctcctaccccctctccgacatcctcgtctcctcctccctctaccacccctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 39385 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 39386 - DNA, 411 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgccagcaataatggtggcaagcaggcgctggagacggtccagcggctgttgccggtgctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 39387 - DNA, 274 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 39388 - DNA, 317 bp, Artificial
  Mutation in BnaC.FAD2.b introduced by TALE nuclease pair BnFAD2_T03
caggatccatgggtgcaggtggaagaatgcaagtgtctcatccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39389 - DNA, 336 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39390 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 39391 - DNA, 344 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39392 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcggagacctcaagaaagcaatcccacctcactgcttcaaacgctccatccctcgctccttctcctacctcctcttcgacatcctcgtctcctcctccctctaccacctctccacagcctacttccctctcccttacctcgcctggcccctctactgggcttgccaaggctgcgtcctaacgggcctctgggtcatagcccacgagtgcggccaccacgccttcagcgactac

SEQ ID NO: 39393 - DNA, 387 bp, Artificial
  Mutation in BnaC.FAD2.b introduced by TALE nuclease pair BnFAD2_T03
caggatccatgggtgcaggtggaagaatgcaagtgactcctccctccaagaagtctgaaaccgacaccatcaagcgcgtaccctgcgagacaccaccattcactctcgggaagcgtggcgctttctcatattttgactgatagtgacctgttcgttgcaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39394 - DNA, 336 bp, Artificial
  Mutation in BnaC.FAD2.b introduced by TALE nuclease pair BnFAD2_T03
caggatccatgggtgcagggggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctggggcatagcccacgagtgcggccaccgcgccttcatcgactac

SEQ ID NO: 39395 - DNA, 342 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39396 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39397 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39398 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcacgactac

SEQ ID NO: 39399 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttacagcgagcgatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39400 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccatcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 39401 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttacagcgagcgatcccacctcactgcttcaaacgctccatcccacgctccttctcctcttcgacatcatcatctcctcctcggcgcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39402 - DNA, 341 bp, Artificial
  Mutation in BnaC.FAD2.b introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccgaactcaagaaagcaatcccacctcactgcttcaaacgctccatccctcgctccttctcctacctcctcttcgacatcctcgtctcctcctccctctaccacctctccacagcctacttccctcgcctcccccaccctctcccttacctcgcctggcccctctactgggcctgccaaggctgcggcctaacgggcctctgggtcatcgcccacgaatgcggccaccacgccttcagcgactac

SEQ ID NO: 39403 - DNA, 346 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaacaccctcaaacgcgtcccctgcgagacaccacccttcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39404 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 39405 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 39406 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39407 - DNA, 318 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39408 - DNA, 328 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 39409 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctgacccctctacggggccggccaaggcggcgtcctaacgggcctctgggtcatagcccacgagggcggcgaccacgcctgcagcgactac

SEQ ID NO: 39410 - DNA, 329 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccgagacctcaagaaagcaatcccacctcactgcttcaaacgctccatcccacgctccttctcctcttcgccatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39411 - DNA, 472 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcaccaccacctgctccggggtcaagccgtgggcctggcacagcaccggcaaacgttggcgtcggcaaacagtggtccggcgcacgcgctctggaggccttgctcacggtggcgggagagttgagagggagacctcaagaaagcaatcccacctcactgcttcaaacgctccatccctcgctccttctcctacctcctcttcgacatcctcgtctcctcctccctctaccccctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39412 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccacccacgccctaacctcgcctggcccctctacggggcctgccaaggctgcgtcctaacggggctctgggtcatagcccacgaatgcggcgacgacgccttcagcaactac

SEQ ID NO: 39413 - DNA, 332 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39414 - DNA, 389 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgaaccttcggtttgatcttctcctgttgctcggctatgtgccaggccatgctagaactcaagaaagcaatcccacctcactgcttcaaacgctccatcccacgctccttctcctcttcgacatcatcatctcctcctcggctcctccctctcccacctctccacagcctacttccctcgcccttacctcgcctggcccctctactgggcctgccaaggctgcgtcctaacgggcctctgggtcatagcccacgagtgcggccaccacgccttcagcgactac

SEQ ID NO: 39415 - DNA, 336 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccctcagtgactac

SEQ ID NO: 39416 - DNA, 346 bp, Artificial
  Mutation in BnaC.FAD2.b introduced by TALE nuclease pair BnFAD2_T03
caggatccatgggtgcaggcggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctcccctcccccaccctctcccttacctcgcctggcccctctactgggcctgccaaggctgcgtcctaacgggcctctgggtcatcgcccacgagtgcggccaccacgccttcagcgactac

SEQ ID NO: 39417 - DNA, 409 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccccctggcttgaccccggagcaggtggtggccatcgccagccacgatggcggcaacagccgctggaccgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39418 - DNA, 324 bp, Artificial
  Mutation in BnaC.FAD2.b introduced by TALE nuclease pair BnFAD2_T03
caggatccatgggtgcaggtggaagaatgcaagtctctcctccaccaacaccctcaaacgcgtcccctgcgagacaccaccattcactctcgggagacctcaagaaagcaatcccacctcactgcttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39419 - DNA, 447 bp, Artificial
  Mutation in BnaC.FAD2.b introduced by TALE nuclease pair BnFAD2_T03
caggatccatgggtgcaggtggcagaatgcaagtctatcctcactccagctcccccggaaccaacaccctcaaacgcgtcccctgcgagacaccacccttcactctaggcgccttatccggtaactatcgtcttgagtccaacccggtaagacacgacttatcgccactggcagcagccactggtaacaggattagcagagcgaggtatgtagaaagcaatcccacctcactgcttcaaacgctccatccctcgctccttctcctacctcctcttcgacatcctcgtctcctcctccctctaccccctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39420 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgatacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39421 - DNA, 350 bp, Artificial
  Mutation in BnaC.FAD2.b introduced by TALE nuclease pair BnFAD2_T03
caggatccatgggtgcagctggcagaatgcaagtctctcctccctccagctcccccgaaaccaaaaccctcaaacacgtcccctgcgagacaccacccttcactctagacctcaagaaaacaatcccaccgcactacttcatacactccacccctccctcctcctcctaccacctcttcgacatcctcgtcgcctcctccctctactacgtctccaccgcctacttccctctcctcccccaccctctcccttacttcgcctggcccctctactgggcctgccatggcggcgtcgtaaccggcctctgggtcatagcccacgaatgcggctaccacgccttcagtgactac

SEQ ID NO: 39422 - DNA, 279 bp, Artificial
  Mutation in BnaC.FAD2.b introduced by TALE nuclease pair BnFAD2_T03
caggatccatgggtgcaggtggcagaatgcaagtctctcctccctccagcaatcccacctcactgcttcaaacgcttcatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39423 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtgaactcaagaaagcaatcccaccgcactgtttcaaacgctcgatccctcgctctttctcctacctcctcttcgacatcctcgtctcctcctccctctaccacctctccacagcctacttccctctccgcccccaccctctcccttacctcgcctggcccctctacggggcctgccaaggctgcgtcctaacgggcctctgggtcatcgcccacgaatgcggccaccgcgccttcagcgactac

SEQ ID NO: 39424 - DNA, 315 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcatcccacctcactgcttcaaacactccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39425 - DNA, 350 bp, Artificial
  Mutation in BnaC.FAD2.b introduced by TALE nuclease pair BnFAD2_T03
caggatccatgggtgcaggtcgaagaatgcaagtatctactccctccagctcccccgaaaccaaaaccctcaaaagcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactggtcctgccaaggctgcgtcctaacgggccgctgggtcatcgcccacgaatgcggccaccacgccttcagcgactac

SEQ ID NO: 39426 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcacttcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39427 - DNA, 368 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaacaccatcaacatcgtggctggcgatggccaccacctgtgccaggcccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 39428 - DNA, 347 bp, Artificial
  Mutation in BnaC.FAD2.b introduced by TALE nuclease pair BnFAD2_T03
caggatccatgggtgcaggtggaagaatgcaagtctatcctccctcccgctcccccggaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccacctcgccttcagcgactac

SEQ ID NO: 39429 - DNA, 372 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagcggctgttgccggtgctgtgccaggcccccgctcaatcccacctcactgcttcaaacgctccatccctcgctccttctcctacctcctcttcgacatcctcgtctcctcctccctctaccacctctccacggcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 39430 - DNA, 347 bp, Artificial
  Mutation in BnaC.FAD2.b introduced by TALE nuclease pair BnFAD2_T03
caggatccatgggtgcaggtggcagaatgcaagtctctcatccctcaagctcccccggaaccaacaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctccccccccctctcccttccctcgcctggcccctctactgggcctgccaaggctgcgtcctaacgggcctctgggtcatcgcccacgaatgctgccaccacgccttcagcgactac

SEQ ID NO: 39431 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccgcgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39432 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactaacctcaataaagcaatcccacctcactgcttcaaacgctccatcccaccctccttctcctcttcgacatcatcatctcctcctcggctcctccctctaccacctctccacagcctacttccctctcccttacctcgcctgacccctctcctgggcctgccaaggctgcgtcctaacgggcctctgggtcatagcccacgagtgcggccaccacgccttcagcgactac

SEQ ID NO: 39433 - DNA, 358 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggcggcaagcaggcgctggaggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39434 - DNA, 385 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaaagactgggcctttcgttttatctgttgtttgtcggtgaacgctctcctgagtaggacaaatccgccggagacctcaagaaagcaatcccacctcactgcttcaaacgctccatcccacgctccttctcctcttcgacatcatcatctcctcctcggctcctccctctaccacctctcctacttcgcctcgcctctctactgggcctgccagggctgcgtcctaaccggcgtctgggtcatagcccacgattgcggccaccacgccttcagcgactac

SEQ ID NO: 39435 - DNA, 332 bp, Artificial
  Mutation in BnaC.FAD2.b introduced by TALE nuclease pair BnFAD2_T03
caggatccatgggtgcaggtggcagaatgcaagtgtctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgagtgcggccaccacgccttcagcgactac

SEQ ID NO: 39436 - DNA, 352 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccatcagcgactac

SEQ ID NO: 39437 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 39438 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagaaagcaatcccacctcactgcttcaaacgctccatccctcgctccttctcctatctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 39439 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39440 - DNA, 375 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttcacgccagcaacgcggcctttttacggttcctggccttttgctggccttttgctcacatgtagacctcaagaaagcaatcccacctcactgcttcaaacgctccatccctcgctccttctcctacctcctcttcgacatcctcgtctcctcctccctcaccctctctcctacttcgcctggcctctctactgggcctgccaagggtgcgtcctaaccggcgtctgggtcatagcccacgagtgcggccaccacgccttcagcgactac

SEQ ID NO: 39441 - DNA, 350 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagcctacttcccactcctcccccaccctctcccttacctcgcctggcccctctactgggcctgccaaggctgcgtcctaacgggcctctgggtcatcgcccacgaatgcggccaccacgccttcagcgactac

SEQ ID NO: 39442 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 39443 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttagacctcaagaaagcaatcccacctcactgcttcaaacgctccatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39444 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacacgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39445 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccccccaccctctcccttacctcgcctggcccctctactgggcctgccaaggctgcgtcctaacgggcctctgggtcatcgcccacgaatgcggccaccacgccttcagcgactac

SEQ ID NO: 39446 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcctcccgcaccctctcccttacctcgcctggcccctctactgggcctgccaaggctgcgtcctaacgggcctctgggtcatcgcccacgagtgcggccaccacgccttcagcgactac

SEQ ID NO: 39447 - DNA, 335 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcccctaacccctctactgggcctgcaatggctgcggccgaacgcgcctcggggtcatagcccgcgagtgcggccaccacgccatcagcaactac

SEQ ID NO: 39448 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatcgcccacgaatgcggccaccacgccttcagcgactac

SEQ ID NO: 39449 - DNA, 331 bp, Artificial
  Mutation in BnaC.FAD2.b introduced by TALE nuclease pair BnFAD2_T03
caggatccatgggtgcaggtggcagaatgcaagtctctactccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcggctcctccctctaccacctctccacagcctacttccctctcccttacctcgcctgacccctctactgggcctgccatggctgcggcctgacgggcctctgggtcatagcccgcgagtgcggccaccacgccttcagcgactac

SEQ ID NO: 39450 - DNA, 300 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctcaccctctctcctacttcgcctggcctctctactgggcctgccagggctgcgtcctaaccggcgtctgggtcatagcccacgagtgcggccaccacgccttcagcgactac

SEQ ID NO: 39451 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39452 - DNA, 335 bp, Artificial
  Mutation in BnaC.FAD2.b introduced by TALE nuclease pair BnFAD2_T03
caggatccatgggtgcaggtggaagaatgcaagtctatccaccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 39453 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39454 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 39455 - DNA, 336 bp, Artificial
  Mutation in BnaC.FAD2.b introduced by TALE nuclease pair BnFAD2_T03
caggatccatgggtgcagggggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39456 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggccggccaaggctgcgtcctaacgggcctctgggtcatagcccacgagtgcggccaccacgccttcagcgactac

SEQ ID NO: 39457 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaacgctccatcccacgctccttctcctcttcgacatcatcatctcctcctcggctcctccctctaccacctctccacagcctacttccctctcccttacctcgcctgaccactctactgggcctgccaaggctgcgtcctaacgggcctctgggtcatagcccacgagtgcggccaccacgccttcagcgactac

SEQ ID NO: 39458 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 39459 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgccagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccatcagcgactac

SEQ ID NO: 39460 - DNA, 348 bp, Artificial
  Mutation in BnaC.FAD2.b introduced by TALE nuclease pair BnFAD2_T03
caggatccatgggtgcaggcggaagaatgcaagtctctcctcactccagctcccccggaaccaacaccctcaaacgcgtcccctgcgagacaccaccattcactagacctcaagaaagcaatcccacctcactgcttcaaacgctccatcccacgctccttctcctacctcctcttcgacatcctcgtctcctcctccctctaccacccctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39461 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctcacccctctactggtcctgccaaggctgcgtcctgacgggcctctgggtcatagcccacgagtgcggcgaccgcgccttcagcgactac

SEQ ID NO: 39462 - DNA, 349 bp, Artificial
  Mutation in BnaC.FAD2.b introduced by TALE nuclease pair BnFAD2_T03
caggatccatgggtgcagctagcagaatgcaagtgtctcctccctccaagaagtctgaaaccgacaccatcaagcgcgtaccctgcgagacaccgcccttcactgagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39463 - DNA, 331 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttgagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggccggccaaggctgcgtcctaacgggcctctgggtcatagcccacgagtgcggccaccacgccttcagcgactac

SEQ ID NO: 39464 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccaccgcactgtttcaaacgctccatccctcgctccttctcctacctcctcttcgacatcctcgtctcctcctccctctaccacctctccacagcctacttccctctcctcccccaccctctcccttccctcgcctgacccctctactgggcctgccaaggctgcgtcctaacgggcctctgggtcatagcccacgagtgcggccaccacgccttcagcgactac

SEQ ID NO: 39465 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39466 - DNA, 295 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagccaacgagtgcggccaccacgccttcagcgactac

SEQ ID NO: 39467 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctgacccctctactgggcctgccagggctgcgtcctaaccggcgtctgggtcatagcccacgagtgcggccaccacgccttcagcgactac

SEQ ID NO: 39468 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccaccattcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39469 - DNA, 416 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagcgcctgctgccggtgctgtgccaggcccacggcttgaccccccagcaggtggtggccatcgccagcaataatggtggcagacctcaagaaagcaatcccacctcactgcttcaaacgctccatcccacgctccttctcctcttcgacatcatcatctcctccgcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39470 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaacctcaagaaagcaatcccaccgcactgtttcaaacgctcgatccctcgctccttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 39471 - DNA, 347 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39472 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 39473 - DNA, 337 bp, Artificial
  Mutation in BnaC.FAD2.b introduced by TALE nuclease pair BnFAD2_T03
caggatccatgtgtgcaggtggaagaatgcaagtctctcctccctccagctcccccggaaccaacaccctcaaacgcgtcccctgcgagacaccaccattcactctaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39474 - DNA, 349 bp, Artificial
  Mutation in BnaC.FAD2.b introduced by TALE nuclease pair BnFAD2_T03
caggatccatgggtgcaggtagaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39475 - DNA, 329 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactctcggaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39476 - DNA, 391 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctaggcgacgaggtggtcgttggccaacgcggccaacgccgggagacctcaagaaagcaatcccacctcactgcttcaaacgctccatccctcgctccttctcctacctcctcttccacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 39477 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 39478 - DNA, 384 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtggataaccgtattaccgcctttgagtgaactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39479 - DNA, 328 bp, Artificial
  Mutation in BnaC.FAD2.b introduced by TALE nuclease pair BnFAD2_T03
caggatccatgggtgcaggtggaagaatgcaagtctctccttcctccagctcccccggaaccaaaaccctcaaacgcgtcccctgcgagacaccacccttcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39480 - DNA, 357 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgccggtgctgtgccaggcccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactaggcctgccaaggctgcgtcctaacgggcctctgggtcatagcccacgagtgcggccaccacgccttcagcgactac

SEQ ID NO: 39481 - DNA, 349 bp, Artificial
  Mutation in BnaC.FAD2.b introduced by TALE nuclease pair BnFAD2_T03
caggatccatgggtgcaggtggtagaatgcaagtgtctcctccctcccagaagtctgaaaccgacaccatcaagcgcgtaccctgcgagacaccgcccttcactgagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacctgcgtctgggtcatagcccacgagtgcggccaacactccttcagcgactac

SEQ ID NO: 39482 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39483 - DNA, 335 bp, Artificial
  Mutation in BnaC.FAD2.b introduced by TALE nuclease pair BnFAD2_T03
caggatccatgggtgcaggtagaagaatgcaagtctctcctccctccagctcccccggaaccaacaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctctgggtcatagcccacgagtgcggccaccacgccttcagcgactac

SEQ ID NO: 39484 - DNA, 350 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctcggcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39485 - DNA, 328 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 39486 - DNA, 376 bp, Artificial
  Mutation in BnaC.FAD2.b introduced by TALE nuclease pair BnFAD2_T03
caggatccatgggtgcaggcggaagaatgcaagtctctcctccctccagctcccccggaaccaacaccctcaaacgcgtcccctgcgagacaccaccattcactctggtggccatcgccagcaatggcggtggccacagccgctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgatggcggccaccacgccttcagcgactac

SEQ ID NO: 39487 - DNA, 316 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctacaagacctcaagaaagcaatcccacctcactgcttcaaacgctccatcccacgctccttctcctacctcctcttcgacatcctcgtctcctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 39488 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 39489 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcgagacctcaagaaagcaatcccacctcactgcttcaaacgccccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39490 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39491 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcttcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 39492 - DNA, 445 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagactgagcctttcgttttatctgttgtttgtcggtgaacgctctcctgagtaggacaaatccgccgggagcggatttgaacgttgtgaagcaacggcccggagggtggcgggcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39493 - DNA, 401 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccatcaaacgcgtcccctgcgagacaccaccattcactctcggcaccggcaacagccgctggaccgtctccagcgcctgcttgccaccagagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccagggctgcgtcctaacgggcctctgggtcatcgcccacgaatgcggccaccacgccttcagcgactac

SEQ ID NO: 39494 - DNA, 336 bp, Artificial
  Mutation in BnaC.FAD2.b introduced by TALE nuclease pair BnFAD2_T03
caggatccatgggtgcaggtcgcagaattcaagtgtctcctccaccccgctcccccgaaaccaaaaccctcaaacgcgtcccctgcgagacaccaccattcactctagacctcaagaaagcaatcccacctcactgcttcaaacgctccatcccacgctccttctcctcttcgccatcatcatctcctcctcggctcctccctctaccacctctccacagcctacttccctctcccttacctcgcctgacccctctactgggcttgccaaggctgcgtcctaacgggcctctgtgtcttcgcccacgaatgcgtccacctcgccttcagtgactac

SEQ ID NO: 39495 - DNA, 351 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactcttagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 39496 - DNA, 449 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaactgccaggcatcaaactaagcagaaggccatccggcaatggcgggggccaccacctgctggggggtcaagccgtgggcctggcacagcaccggcaacagccgctggaccggagacctcaagaaagcaatcccacctcactgcttcaaacgctccatccctccctccttctcctcttcgacatcatcatctcctcctcggctcctccctctaccacctctccacagcctacttccctctcccttacctcgcctgacccctctcctgggcctgccaaggctgcgtcctaacgggcctctgggtcatagcccacgagtgcggccaccacgccttcagcgactac

SEQ ID NO: 39497 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39498 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccataaaaagcaatcccacctcactgcttcaaacgctccatcccacgctccttctcctcttcgacatcatcatctcctcctcggctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 39499 - DNA, 350 bp, Artificial
  Mutation in BnaC.FAD2.b introduced by TALE nuclease pair BnFAD2_T03
caggatccatgggtgcaggtggcagaatgcaagtctatcctccctccagctcccccgaaaccaaaaccctcaaacgcgtcccctgcgagacaccacccttcactctagaccccaagaaagcaatcccacctcactgcttcaaacgctccacccctcgctccttctcctacctcctcttcgacatcctcgtctcctcctccctctaccacccctccacagcctacttccctctcctcccccaccctctcccttacctcgcctggcccctctactgggcctgccaaggctgcgtcctaacgggcctctgggtcatcgcccacgagtgcggccaccacgcctgcagcgactac

SEQ ID NO: 39500 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39501 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctctgggtcatagcccacgagtgcggccaccacgccttcagcgactac

SEQ ID NO: 39502 - DNA, 354 bp, Artificial
  Mutation in BnaC.FAD2.b introduced by TALE nuclease pair BnFAD2_T03
caggatccatgggtgcaggtggaagaatgcaagtctatactccctccagctcccccgaaaccaaaaccctcaaacgcgtcccctgcgagacaccacccttcactctgggaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggccggccaaggctgcgtcctaacgggcctctgtgtcatagcccacgagtgctgccaccacgccttcagcgactac

SEQ ID NO: 39503 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatccctcgctccttctcctacctcctcttcgacatcctcgtctcctcctccatctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39504 - DNA, 450 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggtgttggcttaacgcaacgatgtgcgcgtgtgtaaacccgtggccgaccagtgcctcgtggtgcaggtggtggccatcgccagccacgatggcggcaagtaggcgctggagagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39505 - DNA, 330 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcacccctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39506 - DNA, 334 bp, Artificial
  Mutation in BnaC.FAD2.b introduced by TALE nuclease pair BnFAD2_T03
caggatccatgggtgcaggttgaagaatgcaagtctctcctccctccagctcccccggaaccaacaccctcaaacgcgtcccctgcgagacaccaccatttcggagacctcaagaaagcaatcccacctcactgcttcaaacgctccatcccacgctccttctcctcttctacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39507 - DNA, 347 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39508 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39509 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 39510 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagccaacgagtgcggccaccacgccttcagcgactac

SEQ ID NO: 39511 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 39512 - DNA, 347 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaaacgcgtcccctgcgagacaccacccttcactctcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 39513 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccgtccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39514 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaagggtgcgtcctaaccggcgtcggggtcatagcccacgagtgcggccaccacgccttcagcgactac

SEQ ID NO: 39515 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcttcctaacgtgcctctgggtcatagcccacgagtgcggccaccacgccttcagcgactac

SEQ ID NO: 39516 - DNA, 257 bp, Artificial
  Mutation in BnaC.FAD2.b introduced by TALE nuclease pair BnFAD2_T03
cagaatccatgggtgcaggtggaagaatgcaagtctctcctccctccagctcccccggaaccaacaccctcaaacgcgtcccctgcgagacaccaccattcactctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39517 - DNA, 293 bp, Artificial
  Mutation in BnaC.FAD2.b introduced by TALE nuclease pair BnFAD2_T03
caggatccatgggtgcaggtggcagaatgcaagtgactcctccctccagctcccccggaaccaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgagtgcggccaccacgccttcagcgactac

SEQ ID NO: 39518 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgccagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39519 - DNA, 294 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39520 - DNA, 316 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39521 - DNA, 335 bp, Artificial
  Mutation in BnaC.FAD2.b introduced by TALE nuclease pair BnFAD2_T03
caggatccatgggtgcaggtggaagaatgcaagtctctcctcccaccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39522 - DNA, 352 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcactctgagaccacaagaaagcaatcccacctcactgcttcaaacgctccatcccacgctccttctcctcttcgacatcatcatctcctcctcagctcctccctctaccacctctccacagcctacttccttctcctcccccaccctctcccttacctcgcctggcccctctactgggcctgccaaggctgcgtcctaacgggcctctgggtcatcgcccacgaatgcggccaccacgccttcagcgactac

SEQ ID NO: 39523 - DNA, 329 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39524 - DNA, 349 bp, Artificial
  Mutation in BnaC.FAD2.b introduced by TALE nuclease pair BnFAD2_T03
caggatccatgggtgcaggtggaagaatgcaagtctctcctccctcaagctcccccggaaccaacaccatcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggccggccaaggctgcgtcctaacgggcctctgggtcatcgcccacgaatgcggccaccacgccttcagcgactac

SEQ ID NO: 39525 - DNA, 347 bp, Artificial
  Mutation in BnaC.FAD2.b introduced by TALE nuclease pair BnFAD2_T03
caggatccatgggtgcaggtggcagaatgcaagtctatactcactcccgctcccccgaaaccaaaaccctcaaacgagtcccctgcgagacaccacccttcactctcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggcggcgtcctaacgggcctctgggtcatcgcccacgagtgcgtcctccacgcctgcagcgactac

SEQ ID NO: 39526 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 39527 - DNA, 386 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctcggcaccggcaacagccgctggaccgtctccagcgcctgcttgccaccagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 39528 - DNA, 316 bp, Artificial
  Mutation in BnaC.FAD2.b introduced by TALE nuclease pair BnFAD2_T03
caggatccatgggtgcaggaggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39529 - DNA, 294 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaacctcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39530 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcggcctaaccggcgtctgggtcatagcccacgagtgcggccaccacgccttcagcgactac

SEQ ID NO: 39531 - DNA, 428 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactggcacagcaccggcaacagccgctggaccgtcaggatggccttctgcttagtttgatgcctggcagtttatggcgggcaggaacctcaagaaagcaaacccacctcactgcttcaaacgctccatccctcgctccttctcctacctcctcttcgacatcctcgtctcctcctccctctaccacctctccccagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39532 - DNA, 334 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39533 - DNA, 346 bp, Artificial
  Mutation in BnaC.FAD2.b introduced by TALE nuclease pair BnFAD2_T03
caggatccatgggtgcaggtggaagaatgcaagtctctcctccctccagctccaccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39534 - DNA, 404 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgctggcgatggccaccacctgctgggtggtcaagccgtgggcctggcacagcaccggcaacagccgctggacccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39535 - DNA, 349 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 39536 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctaccaaggctgcgtcctaacgggcctctgggtcatcgcccacgaatgcggccaccacgccttcagcgactac

SEQ ID NO: 39537 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaacgggcctctgggtcatagcccacgagtgcggccaccacgccttcagcgactac

SEQ ID NO: 39538 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttacctcaagaaagcaatcccacctcactgcttcaaacgctccatcccacgctccttctcctcttcgacatcatcatctcctcctcggctcctccctctaccacctctccacagcctacttccctctcccttacctcgtctgacccctctactgggcctgccaaggctgcgtcctaacgggcctctgggtcatagcccacgagtgcggccaccacgccttcagcgactac

SEQ ID NO: 39539 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagaccccaagaaaccattcccacctcctcgcttcaaacgccccacccctctgctcttcacctaccttcccaccgtccttctcctctcctccttcctctactcctcctccacagcctacttccccccccccccccaccctctcccttacctcgcctggcccctctactgggcctgccaaggctgcgtcctaacgggcctctgggtcatcgcccacgaatgcggccaccacgccttcagcgactac

SEQ ID NO: 39540 - DNA, 315 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39541 - DNA, 439 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgtccagcggctgttgccggtgctgtgccaggcccacggcttgaccccggagcaggtggtggccatcgccagcaatattggtggcaagcaggcgctggcacaaagacctcaagaaagcaatcccacctcactgcttcaaacgctccatccccctctccttctcctctccgacatcatcacctcctcctcgcctcctccccctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39542 - DNA, 332 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39543 - DNA, 350 bp, Artificial
  Mutation in BnaC.FAD2.b introduced by TALE nuclease pair BnFAD2_T03
caggatccatgggtgcaggttgaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39544 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccctgaaaccaacaccctcaaacgcgtcccctgcgagacaccaccattcactcacacctcaagaaagcaatcccacctcactgcttcaaacgcaccatccctcgctccctctcccacctcctcttcgacatcctcgtctcctcctccctctaccacctctccacagcctacttccctctcctctcccaccctctcccttacctcgcctggcccctctactgggcctgccaaggctgcgtcctaacgggcctctgggtcatcgcccacgaatgcggccaccacgccttcagcgactac

SEQ ID NO: 39545 - DNA, 349 bp, Artificial
  Mutation in BnaC.FAD2.b introduced by TALE nuclease pair BnFAD2_T03
caggatccatgggtgcaggttgcagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgcctgcagcgactac

SEQ ID NO: 39546 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccatggctgcgtcctaacgggcctctgggtcatcgcccacgaatgcggccaccacgccttcagcgactac

SEQ ID NO: 39547 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcggagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 39548 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 39549 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctggatcatagcccacgagtgcggccaccacgccttcagcgactac

SEQ ID NO: 39550 - DNA, 364 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtccccacgcgtcccagcaatggcggtggcaagcaggcgctggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39551 - DNA, 435 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggtccagcggctgttgccggtgctgtgccaggcccacggcttgaccccccagcagggggtggccatcgccagcaatggcggtggcaagcaggcgctggggagacctcaggaaagcaatcccacctcactgcttcaaacgctccatcccaccctccttctcctcttcgacatcatcatctcctcctcggctcctccctcttccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39552 - DNA, 351 bp, Artificial
  Mutation in BnaC.FAD2.b introduced by TALE nuclease pair BnFAD2_T03
caggatccatgggtgcaggtggaagaatgcaagtatctactccctccagctcccccgaaaccaaaaccctcaaacgcgtcccctgcgagacaccacccttcactctgagacctcaagaaagcaatcccacctcactgcttcaaacgctccatccctcgctccatctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39553 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgtcaaggctgcgtcctaaccggcgtctgggtcatagcccacgagtgcggccaccacgccttcagcgactac

SEQ ID NO: 39554 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgaatgcggccaccacgccttcagcgactac

SEQ ID NO: 39555 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccatgacagacctcaagaaagcaatcccacctcactgcttcaaacgctccatcccacgctccttctcctcttcgacatcatcatctcctcctcggcgcctccctctcccacctctccacagcctacttccctctcccttacctcgcctgacccctctactgggcctgccagggctgcgtcctaacgggcctctgggtcatagcccacgagtgcggccaccacgccttcagcgactac

SEQ ID NO: 39556 - DNA, 335 bp, Artificial
  Mutation in BnaC.FAD2.b introduced by TALE nuclease pair BnFAD2_T03
caggatccatgggtgcaggtggcagaatgcaagtgtctcctccctccaaaaagtctgaaaccgacaacatcaagcgcgtaccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctaacccctctactgggcctgccaaggctgcgtcctaacgggcctctgggtcatagcccacgagtgcggccaccacgccttcagcgactac

SEQ ID NO: 39557 - DNA, 346 bp, Artificial
  Mutation in BnaC.FAD2.b introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggccccgctactgggcctcccaaggctgcgtcctaacgggcctctgggtcatcgcccacgaatgcggccaccacgccttcagcgactac

SEQ ID NO: 39558 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccgtcagcgactac

SEQ ID NO: 39559 - DNA, 334 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39560 - DNA, 335 bp, Artificial
  Mutation in BnaC.FAD2.b introduced by TALE nuclease pair BnFAD2_T03
caggatccatgggtgcaggtggaagaatgcaagtctctcctccctcacgctcccccgaaaccaaaaccctcaaacgcgtcccctgcgagacaccacccttcactgtagaactcaagaaagcaatcccaccgcactgtttcaaacgctccatccctcgctccttctcctacctcctcttcgacatcctcgtctcctcctccctctaccacctctccacagcctacttccctctcacttacctcgcctgacccctctactgggcctgccaaggctgcggcctaacgggcctctgggtcatagcccacgagtgcggccaccacgccttcagcgactac

SEQ ID NO: 39561 - DNA, 313 bp, Artificial
  Mutation in BnaC.FAD2.b introduced by TALE nuclease pair BnFAD2_T03
caggatccatgggtgcaggtggcagaatgcaagtgtatacacactcccgctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctcaccctctctcctacttcgcctggcctctctactgggcctgccaagggtgcgtcctaaccggcgtcggtgtcatagcccacgagtgcgtccacctcgcctgcagcgactac

SEQ ID NO: 39562 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccttccaaggctgcgtcctaacgggcctctgggtcatagcccacgagtgcggccaccacgccttcagcgactac

SEQ ID NO: 39563 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgccatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39564 - DNA, 280 bp, Artificial
  Mutation in BnaC.FAD2.b introduced by TALE nuclease pair BnFAD2_T03
caggatccatgggtgcaggtggcagaatgcaagtctcgacctcaagcaagcaatcccaccccactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39565 - DNA, 336 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 39566 - DNA, 333 bp, Artificial
  Mutation in BnaC.FAD2.b introduced by TALE nuclease pair BnFAD2_T03
caggatccatgggtgcaggcggcagaatgcaagtccctcctccctccagctcccccggaaccaacaccctcaaacgcgtcccctgcgagacaccaccattcactaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39567 - DNA, 347 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39568 - DNA, 293 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 39569 - DNA, 336 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcctctgggtcatagcccacgagtgcggccaccacgccttcagcgactac

SEQ ID NO: 39570 - DNA, 336 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39571 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 39572 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactattaaaattaaagttttaaaaagtaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 39573 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtccccttcgagacaccaccattcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgtcccctctactgggcctgccaaggctgcgtcctaacgggcctctgggtcatcgcccacgaatgcggccaccacgccttcagcgactac

SEQ ID NO: 39574 - DNA, 431 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggcaggtggtggccatcgccagcaatggcggtggcaagcaggcgctggagacggtccagcggctgttgccggtgctgtgccaggcccacggctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39575 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttcctcaagaaagcaatcccacctcactgcttcaaacgctccatccctcgctccttctcctacctactcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39576 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgagacctcaagaaagcaatcccacctcactgcttcaaacgctccatccctcgctccttctcctacctcctcttcgacatcctcgtctcctcctccctcgaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39577 - DNA, 346 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactactcaagaaagcaatcccaccgcactgtttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39578 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattgagcggatttgtcctactcaggagagcgttcaccgacaaacaacagataaaacgaaaggcccagtcttccctcaagaaagcaatcccacctcactgcttcaaacgctccatcccacgctccttctcctcttcgacatcatcatctcctcctcgtctcctccctcttccacctctccgcagcctgcttccctctcccttacctcgcctgacccctctactgggcctgcctaggctgcgtccgaacgggcctctgggtcatagcccacgagtgcggccagcacgccttcagcgactac

SEQ ID NO: 39579 - DNA, 336 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 39580 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgtagagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39581 - DNA, 349 bp, Artificial
  Mutation in BnaC.FAD2.b introduced by TALE nuclease pair BnFAD2_T03
caggatccatgggtgcaggtggaagaatgcaagtatctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcatcccccaccctctcccttacctcgcctggcccctctactgggcctgccaaggctgcgtcctaacgggcctctgggtcatcgcccacgaatgcggccacaacgccttcagcgactac

SEQ ID NO: 39582 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcctcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39583 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgacacaccgcccttcactcaagaaagcaaacccaccgcactgtttcaaacgctccatccctcgctccttctcctacctcctcttcgacatccgcgtctcctcctcggctcctccctctaccacctctccacagcctacttccctctccctttcctcgcctgacccctctactgggcctgccaaggctgcgtcctaacgcgcctctgggtcatagcccacgagtgcggccaccacgccatcagcgactac

SEQ ID NO: 39584 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcgtccaccacgccatcagcgactac

SEQ ID NO: 39585 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39586 - DNA, 350 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctcgcccttacctcgcctggcccctctactgggcctgccaaggctgcgtcctaacgggcctctgggtcatcgcccacgaatgcggccaccacgccttcagcgactac

SEQ ID NO: 39587 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39588 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39589 - DNA, 325 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccaactcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 39590 - DNA, 292 bp, Artificial
  Mutation in BnaC.FAD2.b introduced by TALE nuclease pair BnFAD2_T03
caggatccatgggcgcaggtggaagaatgcaagtctctcctccctccagctcccccggaaccaacaccctcaaaagcaatcccacctcactgcttcaaacgctccatcccacgctccttctcctcttcgacatcatcatctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 39591 - DNA, 348 bp, Artificial
  Mutation in BnaC.FAD2.b introduced by TALE nuclease pair BnFAD2_T03
caggatccatgggtgcagggggaagaatgcaagtctctactccctccagctcccccgaaaacaaaaccctcaaacgcgtcccctgcgagacaccacccttcactcgaactaaagaaagcaatcccacctcactgcttcaaacgctccatcccacaccccttctcctccctcctcttcgacatcctcgtctcctcccccctctaccacccctccacagcctacttccctttcctcccccaccctctcccttacctcgcctggcccctctactgggcctgccaaggctgcggcctaacgggcctctgggtcatcgcccacgagtgcggccaccacgccctcagcgactac

SEQ ID NO: 39592 - DNA, 337 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 39593 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 39594 - DNA, 324 bp, Artificial
  Mutation in BnaC.FAD2.b introduced by TALE nuclease pair BnFAD2_T03
caggatccatgggtgcaggtggcagaatgcaagtgtctcctccctccagctcccccggaaccaacaccctcaaacgcgtcccctgcgagacaccaccattcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39595 - DNA, 335 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39596 - DNA, 342 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39597 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 39598 - DNA, 334 bp, Artificial
  Mutation in BnaC.FAD2.b introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39599 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgtcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggccatagcccacgagtgcggccaccacgccttcagcgactac

SEQ ID NO: 39600 - DNA, 350 bp, Artificial
  Mutation in BnaC.FAD2.b introduced by TALE nuclease pair BnFAD2_T03
caggatccatgggtgcaggtggcagaatgcaagtctctcctcactccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcggggtcatcgcccacgaatgcggccaccacgccttcagcgactac

SEQ ID NO: 39601 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggccatcgcccacgaatgcggccaccacgccttcagcgactac

SEQ ID NO: 39602 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 39603 - DNA, 334 bp, Artificial
  Mutation in BnaC.FAD2.b introduced by TALE nuclease pair BnFAD2_T03
caggatccatgggtgcaggtggcagaatgcaagtctgtccccccaccagctcccccggaaacaacaccctaaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttgcctcgcctggcccctctccgaggcctgccaaggctgcggccggacgggcctctgggtcatagcccacgagtgctaccaccacgccatcagcgactac

SEQ ID NO: 39604 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 39605 - DNA, 418 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacctctgacttgagcgtcgatttttgtgatgctcgtcagggggggccatcgccagcaatggcggcggcaggccggcgctgagacctcaagaaagcaatcccacctcactgcttcaaacgctccatccctcgctccttctcctacctcctcttcgacatcctcgtctcctcctccctctaccacctctccacagcctacttccctctcctcccccaccctcgcccttacctcgcctggcccctctactgggcctgccaaggctgcgtcctaacgggcctctgggtcatcgcccacgaatgcggccaccacgccttcagcgactac

SEQ ID NO: 39606 - DNA, 346 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcacgacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccagggctgcgtcctaaccggcgtctgggtcatagcccacgagggcggccaccacgccttcagcgactac

SEQ ID NO: 39607 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctacgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 39608 - DNA, 343 bp, Artificial
  Mutation in BnaC.FAD2.b introduced by TALE nuclease pair BnFAD2_T03
caggatccatgggtgcaggtcgaagaatgcaagtctctactccctccagctcccccgaaaccaaaaccctcaaacgcgtcccctgcgagacaccacccttcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39609 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 39610 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcaagaaagcaatcccacctcactgcttcaaacgctccatccctcgctccttctcctacctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39611 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 39612 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 39613 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagttcggccaccacgccttcagcgactac

SEQ ID NO: 39614 - DNA, 348 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 39615 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcggacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39616 - DNA, 317 bp, Artificial
  Mutation in BnaC.FAD2.b introduced by TALE nuclease pair BnFAD2_T03
caggatccatgggtgcaggcggaagaatgcaagtctctcctccctccagctcccccgaaaccaaaaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 39617 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaggcaatcccacctcactgcttcaaacgccccatcccaccctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39618 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcttggtcatcgcccacgaatgcggccaccacgccttcagcgactac

SEQ ID NO: 39619 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctcgatccctcgctctttctcctacctcctcttcgacatcctcgtctcctcctccctctaccacctctccacagcctacttccctctcctcccccaccctctcccttccctcccctggcccctctactgggcctgccaaggctgcgtcctaactggcctctgggtcatcgcccacgagtgcggccaccacgccttcagcgactac

SEQ ID NO: 39620 - DNA, 353 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggagacctcaagaaagcaatcccacctcattgcttcaaacgctccatcccacgctccttctcctcttcgacatcatcatctcctcctcgcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 39621 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctccttctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39622 - DNA, 314 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctcaccctctctcctacttcgcctggcctctctactgggcctgccagggctgcggcctaaccggcgtctgggtcatagcccacgagtgcggccaccacgccttcagcgactac

SEQ ID NO: 39623 - DNA, 279 bp, Artificial
  Mutation in BnaC.FAD2.b introduced by TALE nuclease pair BnFAD2_T03
caggatccatgggtgcaggtggcagaatgcaagtctctcctccctccagtctctccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaaggcggccaccacgccttcagcgactac

SEQ ID NO: 39624 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcttcaaacgctccatcccacgctccttctcctcttcgacatcatcatctcctcctcggctcctccctctaccacctctccacagcctacttccctctcccttacctcgcctgacccctctacttggcctgccaaggctgcgtcctaacgggcctctgggtcatagcccacgagtgcggccaccacgccttcagcgactac

SEQ ID NO: 39625 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactcggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39626 - DNA, 353 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcctcaagaaagcaatcccacctcactgcttcaaacgctccatccctcgctccttctcctacctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcattgcccacgaatgcggccaccacgccttcagcgactac

SEQ ID NO: 39627 - DNA, 349 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctcccctcccccaccctctcccttacctcgcctggcccctctactgggcctgccaaggctgcgtcctaacgggcctcggggtcatagcccacgagtgcggccaccacgccttcagcgactac

SEQ ID NO: 39628 - DNA, 336 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactctggacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 39629 - DNA, 341 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccgaactcaagaaagcaatctcaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39630 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39631 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaaggcggccaccacgccttcagcgactac

SEQ ID NO: 39632 - DNA, 335 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaacatcaagcgcgtaccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39633 - DNA, 265 bp, Artificial
  Mutation in BnaC.FAD2.b introduced by TALE nuclease pair BnFAD2_T03
caggatccatgggtgcaggtggaagaatgcaagtgtctcctccctccagtctctccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39634 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactggagacctcaagaaagcaatcccacctcactgcttcaaacgctccatcccacgctccttctcctcttcgacatcatcatctcctcctcggctcctccctctaccacctctccacagccttcttccctctcccttacctcgcctgacccctctactgggcctgccaaggctgcgtcctaacgggcctctgggtcatagcccacgagtgcggccaccacgccttcagcgactac

SEQ ID NO: 39635 - DNA, 337 bp, Artificial
  Mutation in BnaC.FAD2.b introduced by TALE nuclease pair BnFAD2_T03
caggatccatgggtgcaggtggcagaatgcaagtctctaatccctcaagctcccccggaaccaacaccctcaaacgcgtcccctgcgagacaccaccattcactctaagacctcaagaaagcaatcccacctcactgcttcaaacgctccatcccacgctccttctcctcttcgacatcatcatctcctcctcggctcctccctctaccacctctccacagcctacttccctctcccttacctctcctgacccctctactgggcctgccaaggctgcgtcctaacgggcctctgggtcatagcccacgagtgcggccaccacgccttcagcgactac

SEQ ID NO: 39636 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcaagaaagcaatcccacctcactgcttcaaacgctccatccctcgctccttctcctacctcctcttcgacatcctcgtctcctcctccctctaccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 39637 - DNA, 397 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcgccagccacgatggcgacaagcaggcgctggagacggtccagcggctgttgccggtgctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39638 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcatgccaaggctgcgtcctaaccggcgtctgggtcatagcccacgagtgcggccaccacgccttcagcgactac

SEQ ID NO: 39639 - DNA, 397 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgccagccacgatggcggcaagcaggcgctggagacggtccagcggctgttgccggtgctgagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39640 - DNA, 417 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttggccaccacctgctggggggtcaagccgtgggcctggcacgatggcggcaagcaggcgctggaggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39641 - DNA, 304 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgcttcaaacgctccatccctcgctccttctcctccctcctcttcgacatcctcgtctcctcctccctctaccacctctccacagcctacttccctctcccttacctcgcctgacccctctactgggcctgccaagggtgcgtcctaacgggcctctgggtcatcgcccacgaatgcggccaccacgccttcagcgactac

SEQ ID NO: 39642 - DNA, 436 bp, Artificial
  Mutation in BnaC.FAD2.b introduced by TALE nuclease pair BnFAD2_T03
caggatccatgggtgcaggtggaagaatgcaagtatatcctccctccagctcccccgaaaccaaaaccctcaaacgcgtcccctgcgagacaccacccttcactctcgcaatttctttatttctgttttacgcgcaattaattttgatatggtaggttctaacccttccattattcagatgtgtaatccaaacaacctcaagaaagcaatcccacctcactgcttcaaacgctccatccctcgctccttctcctacctcctctccgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 39643 - DNA, 342 bp, Artificial
  Mutation in BnaC.FAD2.b introduced by TALE nuclease pair BnFAD2_T03
caggatccatgggtgcaggcggaagaatgcaagtgtctcctccctccaagaagtctgaaaccgacaacatcaagcgcgtaccctgcgagacaccgcccttcactgaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgcgaaggctgcgtccgaacgggcctctgggtcatcgcccacgaatgtgtcctccacgccagcagcgactac

SEQ ID NO: 39644 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacaggcccacggcttgaccccccagcaggtggtggccatcgccagcaataatggtggcggagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39645 - DNA, 387 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccaccattcactcttgaccccggagcaggtggtggccatcgccagccacgatggcggcaagcaggcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 39646 - DNA, 336 bp, Artificial
  Mutation in BnaC.FAD2.b introduced by TALE nuclease pair BnFAD2_T03
caggatccatgggtgcaggtagaagaatgcaagtctctcctccctccagctcccccggaacaaacaccctcaaacgcgtcccctgcgagacaccaccattcactctcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39647 - DNA, 349 bp, Artificial
  Mutation in BnaC.FAD2.b introduced by TALE nuclease pair BnFAD2_T03
caggatccatgggtgcaggtggaagaatgcaagtatctactccctccagctcccccgaaaccaaaaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccctcagcgactac

SEQ ID NO: 39648 - DNA, 414 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaaacgcgtcccctgcgagacaccacccttcacgcccgccaccctccgggccgttgcttcacaacgttcaaatccgctcccggcggatttgtcctaccggagacctcaagaaagcaatcccacctcactgcttcaaacgctccatccctcgctccttctcctacctcctcttcgacatcctcgtctcctcctccccctaccccctctccccagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39649 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcgggggagacctcaagaaagcaatcccacctcactgcttcaaacgctccatcccacgctccttctcctcttcgacatcatcatctcctcctcggctcctccctctaccacctctccgcagcctacttccctctcccttacctcgcctgacccctctactgggcctgccaaggctgcgtcctaacgggcctctgggtcatagcccacgagtgcggccaccacgccttcagcgactac

SEQ ID NO: 39650 - DNA, 334 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39651 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttgcctcgcctgacccctctactgggcctgccaaggctgcgtcctaacgggcctctgggtcatagcccacgagtgcggccaccacgccttcagcgactac

SEQ ID NO: 39652 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttccctcaagaaagcaatcccacctcactgcttcaaacgctccatcccacgctccttctcctcttcgacatcatcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39653 - DNA, 331 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgacta

SEQ ID NO: 39654 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 39655 - DNA, 335 bp, Artificial
  Mutation in BnaC.FAD2.b introduced by TALE nuclease pair BnFAD2_T03
caggatccatgggtgcaggtggaagaatgcaagtctctcctcctccagctcccccggaaccaacaccctcaaacgcgtcccctgcgagacaccaccattcactctcgacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39656 - DNA, 335 bp, Artificial
  Mutation in BnaC.FAD2.b introduced by TALE nuclease pair BnFAD2_T03
caggatccatgggtgcaggtagaagaatgcaagtctctcctcctccccgctcccccggaaccaacaccctcaaacgcgtcccctgcgagacaccaccactcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagggcggccaccacgccttcagcgactac

SEQ ID NO: 39657 - DNA, 335 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39658 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 39659 - DNA, 312 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcagcgactac

SEQ ID NO: 39660 - DNA, 305 bp, Artificial
  Mutation in BnaC.FAD2.b introduced by TALE nuclease pair BnFAD2_T03
caggatccatgggtgcaggtagaagaatgcaagtctctcctccctccagctcccccggaaccaacaccctcaaacgcgtcccctgcgagacaccaccattcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 39661 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccatcagcgactac

SEQ ID NO: 39662 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcgactcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39663 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaacccacaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39664 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgcctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39665 - DNA, 334 bp, Artificial
  Mutation in BnaC.FAD2.b introduced by TALE nuclease pair BnFAD2_T03
caggatccatgggtgcaggtggaagaatgcaagtgtctcctcactccaagaagtctgaaaccgacaccatcaagcgcgtaccctgcgagacaccgcccttcactgtaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctggggcatcgcccacgaatgcggccaccacgccttcagcgactac

SEQ ID NO: 39666 - DNA, 313 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctcaccctctctcctacttcgcctggcctctctactgggcctgccaagggtgcgtcctaacgggcctctgggtcatagcccgcgagtgcggccaccacgccttcagcgactac

SEQ ID NO: 39667 - DNA, 337 bp, Artificial
  Mutation in BnaC.FAD2.b introduced by TALE nuclease pair BnFAD2_T03
caggatccatgggtgcaggtggcagaatgcaagtctctcatccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccatcagcgactac

SEQ ID NO: 39668 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccgggcccctctggggggcctgccgagggtgcgtgctaaggggcgtgtgggtcgtggcgggcgggtgggggcgggacgccgtcaggggcggg

SEQ ID NO: 39669 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccatcagcgactac

SEQ ID NO: 39670 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctccttctcctacctcctcttcgacatcctcgtctcctcctccctctaccatctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39671 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 39672 - DNA, 336 bp, Artificial
  Mutation in BnaC.FAD2.b introduced by TALE nuclease pair BnFAD2_T03
caggatccattggtgcaggtggaagaatgcaagtgtctcctccctccaaaaagtctgaaaccgacaacatcaagcgcgtaccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39673 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39674 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaacgggcctctgggtcatcgcccacgaatgcggccaccacgccttcagcgactac

SEQ ID NO: 39675 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 39676 - DNA, 363 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccaccattcactctcgcggcgggggtgggggttacgcgcaaagaccccaagaaagcaatcccacctcactgcttcaaacgctccatcccacgctccttctcctcttcgacatcatcatctcctccccggctcctccctctaccacctctccacagcctacttccctctcccttacctcgcctgacccctctactgggcctgccaaggctgcgtcctaactggcctcggggtcatagcccacgagtgcggccaccacgccgtcagcgactac

SEQ ID NO: 39677 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaacgctccatcccacgctccttctcctcttcgacatcatcatctcctcctccgctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39678 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39679 - DNA, 349 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctccaccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 39680 - DNA, 429 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactcttccagcgcctgcttgccaccattattgctggcgatggccaccacctgctggggggtcaagccgtgggcctggcacagcaccggcaacagccggagacctcaagaaagcaatcccacctcactgcttcaaacgctccatcccacgctccttctccccttcgacaccatcatctcctcctcggcgcctccctctcccacctccccccagcctacttccctctcccttccctcgcctgacccctctactgggcctgccaaggcggcgtcctaacgggcctctgggtcatagcccacgagtgcggcgaccacgccgtcagcgactac

SEQ ID NO: 39681 - DNA, 346 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactctcaggcgctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39682 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcgcgactac

SEQ ID NO: 39683 - DNA, 328 bp, Artificial
  Mutation in BnaC.FAD2.b introduced by TALE nuclease pair BnFAD2_T03
caggatccatgggtgcaggtggaagaatgcaagtgtctcctcactcccagaagtctgaaaccgacaccatcaagcgcgtaccctgcgagacaccgcccttcactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39684 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctctgggtcatcgcccacgaatgcggccaccacgccttcagcgactac

SEQ ID NO: 39685 - DNA, 322 bp, Artificial
  Mutation in BnaC.FAD2.b introduced by TALE nuclease pair BnFAD2_T03
caggatccatgggtgcaggtggcagaatgcaagtgtctcctccctccagctcccccggaaccaacaccctcaaacgcgtcccctgcgagcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39686 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39687 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctggggcatagcccacgagtgcggccaccacgccttcagcgactac

SEQ ID NO: 39688 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctccttccccaccctctcccttacctcgcctggcccctctactgggcctgccaaggctgcgtcctaacgggcctctgggtcatagcccacgagtgcggccaccacgccttcagcgactac

SEQ ID NO: 39689 - DNA, 342 bp, Artificial
  Mutation in BnaC.FAD2.b introduced by TALE nuclease pair BnFAD2_T03
caggatccatgggtgcaggtggcagaatgcaagtctctcacccctccagctcccccgaaaccaaaaccctcaaacacgtcccctgcgagacaccacccttccctcaagaaagcaatcccacctcactgcttcaaacgctccatccctcgctccttctcctacctcctcttcgacatcctcgtctcctcctccctctaccacctctccacagcctacttccctcgcctccccccccctctcccttacctcgcctggcccctctactgagccggccatggctgcgtcctaacgcgcctctggggcatctcccacgaatgctgccaccacgcctgcagcgactac

SEQ ID NO: 39690 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcttcctaacgggcctctgggtcatagcccacgagtgcggccaccacgccttcagcgactac

SEQ ID NO: 39691 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcgacctcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39692 - DNA, 398 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctcggctgttgccggtgctgtgccaggcccacggcttgaccccggagcaggtggtggccatcggagacctcaagaaagcaatcccacctcactgcttcaaacgctccatcccacgctccttctcctcttcgacatcatcatctcctcctctgctcctccctctcccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 39693 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccacctcaggaaagcaatcccacctcactgcttcaaacgctccatccctcgctccttctcctacctcctcttcgacatcctcgtctcctcctccctctaccacctctcaacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39694 - DNA, 347 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgaatgcggccaccacgccttcagcgactac

SEQ ID NO: 39695 - DNA, 415 bp, Artificial
  Mutation in BnaC.FAD2.b introduced by TALE nuclease pair BnFAD2_T03
caggatccatgggtgcaggtggaagaatgcaagtctctcctccctcccgctcccccggaaccaacaccctcaaacgcgtcccctgcgagacaccaccattcactcttggccaccacctgctgaggggtcaagccgtgggcctggcacagcaccggcaacagccgctggaggagacctcaagaaagcaatcccacctcactgcttcaaacgctccatccctcgctccttctcctacctcctcttcgacatcctcgtcccctcctccctctaccccctctccacagcctacttccctctcctcccccaccctctcccttacctcgcctggcccctctactgggcctgccaaggctgcgtcctaacgggcctctgggtcatcgcccacgaatgctgccaccacgccttcagcgactac

SEQ ID NO: 39696 - DNA, 347 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39697 - DNA, 306 bp, Artificial
  Mutation in BnaC.FAD2.b introduced by TALE nuclease pair BnFAD2_T03
caggatccatgggtgcaggtggcagaatgcaagtgtctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39698 - DNA, 409 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgactacggcgtgatcgtggacaccacgagcatcacaaaaatcgacgctcaagtcagaggtggcgaaacccggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39699 - DNA, 335 bp, Artificial
  Mutation in BnaC.FAD2.b introduced by TALE nuclease pair BnFAD2_T03
caggatccatgggtgcagggggcagaatgcaagtgtctcctccctccaagaagtctgaagccgacaccatcaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagcctacttccctctcccttacctcgcctgacccctctacggggcctgccaaggctgcgtcctaacgggcctctgggtcatcgcccacgaatgcggccaccacgccttcagcgactac

SEQ ID NO: 39700 - DNA, 291 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctggggcatagcccacgagtgcgtccaccacgccttcagcgactac

SEQ ID NO: 39701 - DNA, 308 bp, Artificial
  Mutation in BnaC.FAD2.b introduced by TALE nuclease pair BnFAD2_T03
caggatccatgggtgcaggtggcagaatgcaagtgtatcctcactccaagaagtctgaaaccgacaccatcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39702 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcgcacctcactgcttcaaacgccccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39703 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 39704 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcggcgactac

SEQ ID NO: 39705 - DNA, 342 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccagaactcaagaaagcaatcccaccgcactgtttcaaacgctcgatccctcgctccttctcctacctcctcttcgacatcctcgtctcctcctccctctaccccctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39706 - DNA, 317 bp, Artificial
  Mutation in BnaC.FAD2.b introduced by TALE nuclease pair BnFAD2_T03
caggatccatgggcgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctagcgggcctctgggtcatagcccacgagtgcggccaccacgccttcagcgcctac

SEQ ID NO: 39707 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctagcaggcgctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgagcctctgggtcatagcccacgagtgcttcgaccacgccatcagcgactac

SEQ ID NO: 39708 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctcccccttacctcgcctggcccctctactgggcctgccaaggctgcgtcctaacgggcctctgggtcatcgcccacgaatgcggccaccacgccttcagcgactac

SEQ ID NO: 39709 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 39710 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39711 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaacctcaaacgcgtcccctgcgagacaccaccattcacacctcaagaaagcaatcccacctcactgcttcaaacgctccatcccacgctccttctcctcttcgacatcatcatctcctcctcggctcctccctctaccacctctccacagtctacttccctctcccttacctcgcctgacccctctactgggcctgccaaggctgcgtcctaacgggcctctgggtcatagcccacgagtgcggccaccacgccttcagcgactac

SEQ ID NO: 39712 - DNA, 327 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctacgagacaccacccttcactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39713 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctccccccccctctccctgacctcccctggcccctctactgggcctgccaaggctgcgtcctaacgggcctctgggtcatcgcccacgaatgcggccaccacgccatcagcgactac

SEQ ID NO: 39714 - DNA, 349 bp, Artificial
  Mutation in BnaC.FAD2.b introduced by TALE nuclease pair BnFAD2_T03
caggatccatgggtgcaggtggaataatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39715 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctccccccccctctcccttaccacgcctggcccctctactgggcctgccaaggctgcgtcctaacgggcctctgggtgatcgcccacgaatgcggccaccacgccttcagcgactac

SEQ ID NO: 39716 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacatgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 39717 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccccccttcagacctcaagaaagcaatcccacctcactgcttcaaacgctccatccctcgctccttctcctacctcctcttcgacagcctcacctcctcctccctctaccacctcgccacagcctacttccctctcctcccccaccctctcccttacttcgcctggcccctctactgggcctgccaaggctgcgtcctaaccggcgtctgggtcatagcccacgagtgcggccaccacgccttcagcgactac

SEQ ID NO: 39718 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaattccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 39719 - DNA, 464 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagcttgacggggaaagccggcgaacgtggcgagaaaggaagggaagaaagcgaaaggagcgggcgctaggtttagggttgcgatttagtgctttacggcacctcgaccccaaaagacctcaagaaagcaatcccacctcactgcttcaaccgctccatccctcgctccttcccctacctcctcttccacatcctcgtctcctcctccctctaccccctctccacaccctccttccctctcctccccccccctctcccttacctcgcctggcccctctactgggcctgccaaggctgcttcctaacgggcctctgggtcatagcccacgagtgcggccaccacgccttcagcgactac

SEQ ID NO: 39720 - DNA, 332 bp, Artificial
  Mutation in BnaC.FAD2.b introduced by TALE nuclease pair BnFAD2_T03
caggatccatgggtgcaggtggcagaatgcaagtgtatcctccctccaagaagtctgaaaccgacaccatcaagcgcgtaccctgcgagacaccgcccttcactacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39721 - DNA, 325 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39722 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccatcagcgactac

SEQ ID NO: 39723 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaaaaggagcaattaaaggtactctctaatcctgacctgttggagtttgcttccggtctgaggcctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39724 - DNA, 357 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctcggcctttttacggttcctctccctcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 39725 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagcaagcaatcccaccgccctgcttcaaacgctccatcccaccctccttctcctcttcgcctccatcatctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 39726 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagaccccatgaaaacaatcctacctcactgcttcaaacgctccatcccccgctccttctcctcttcgccatcatcatctcctctactgctcctccccctaccacctctccacagccttcttccctctcccctacctcgcctggcccctctactgggcctgccagggctgcgtcctaaccggcgtctgggtcatagcccacgagtgcggccaccacgccttcagcgactac

SEQ ID NO: 39727 - DNA, 294 bp, Artificial
  Mutation in BnaC.FAD2.b introduced by TALE nuclease pair BnFAD2_T03
caggatccatgggtgcaggtggcagaatgcaagtgtctcctccctccaagaagtctgaaaccgacaccatcaagaaagcaatcccacctcactgcttcaaacgctccatcccacgctccttctcctcttcgacatcatcatctcctcctcggctcctccctctaccacctctccacagcctccttccctctcccttacctcgcctgacccctctactgggcctgccaaggctgcgtcctaacgggcctctgggtcatagcccacgagtgtggccaccacgccttcagcgactac

SEQ ID NO: 39728 - DNA, 329 bp, Artificial
  Mutation in BnaC.FAD2.b introduced by TALE nuclease pair BnFAD2_T03
caggatccatgggtgcaggtggaagaatgaaagtctctcctccctccagctcccccgaaaccaaaaccctcaaacgcgtcccctgcgagacaccacccttcactctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39729 - DNA, 342 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39730 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaacctcaaacgcgtcccctgcgagacaccacccttcactcaagaaagcaatcccacctcactgcttcaaacgctctatccctcgctccttctcctacctcctcttcgacatcctcgtgacctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39731 - DNA, 335 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccatcaaacgcgtcccctccgagacaccacccttcactcagacctcaagaaagcaatcccacctcactgcttcaaacgctccatcccactctccttctcctcttcgacatcatcatctcctcctcggctcctccctctaccacctctccacagcctacttccctctcccttacctcacctgacccctctcctgggcctgccaaggctgcggcctaacgggcctctgggtcatatcccgcgagtgcggcctccgcgccagcaacgactgc

SEQ ID NO: 39732 - DNA, 348 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactggaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39733 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39734 - DNA, 350 bp, Artificial
  Mutation in BnaC.FAD2.b introduced by TALE nuclease pair BnFAD2_T03
caggatccatgggtgcaggtggaagaatgcaagtatatcctcactccagctcccccgaaaccaaaaccctcaaacgcgtcccctgcgagacaccaccctccactccagacatcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39735 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 39736 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtcctaacgggcctctgggtcatagcccacgagtgcggccaccacgccttcagcgactac

SEQ ID NO: 39737 - DNA, 326 bp, Artificial
  Mutation in BnaC.FAD2.b introduced by TALE nuclease pair BnFAD2_T03
caggatccatgggtgcaggtggaagaatgcaagtctctcctcactccagctcccccgaaaccaaaaccctcaaacgcgtcccctgctagacaccacccttaccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 39738 - DNA, 346 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctgtagagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39739 - DNA, 337 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactctcaagaaagcaatcccaccgcactgtttcaaacgctcgatccctcgctctttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 39740 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39741 - DNA, 335 bp, Artificial
  Mutation in BnaC.FAD2.b introduced by TALE nuclease pair BnFAD2_T03
caggatctatgggtgcaggtggaagaatgcaagtctctcctccctccagctcccccgaaaccaacaccctcaaacgcgtcccctgcgagacaccacccttcactcagacctcaagaaagcaagcccacctcactgcttcatacgctccatcccacgctccttctcctcctcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 39742 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccaccgcactgtttcaaacgctcgatccctcgctctttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39743 - DNA, 395 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagccaccacccttccctctctgctgctgcgagcggcatcagctcactcaacggcggtaatacggttatccacagaatcacacctcaagaaagaaatcccaccacactgcttcaaacgctccatcccacgctccttctcctcaacgacatcatcatctcctcctcgactcctcccgctaccacctccccgcagcctacttccctctcccttacctcgcctaacccctctactgggcctgccaaggctgaggcctaacgcgcctctgggtcatcgcccacgaatgcggccaccacgccaacagcgactac

SEQ ID NO: 39744 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 39745 - DNA, 329 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctagacctcaagaaagcaatcccacctcactgcttcaaacgctccatcccacgctccttctcctcttcgacttcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39746 - DNA, 428 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttcctttttttctgcgcgtaatctgctgcttgcaaacaaaaaaaccaccgctacccgactgggctggcgctgagcgaactgagacctcaagaaagcaatcccacctcactgcttcaaacgctccatccctcgctccttctcctacctcctcttctccatcctcgtctcctcctccctctaccacctctccccagcctacttccccctccgccccccccctctcccttacctcgcctggcccctctactgggcctgccaaggctgcgtcctaacgggcctctgggtcatagcccacgagtgcggccaccacgccttcagcgactac

SEQ ID NO: 39747 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggccgctgggtcatcgcccacgaatgcggccaccacgccttcagcgactac

SEQ ID NO: 39748 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacccccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39749 - DNA, 336 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaacaccctcaaacgcgtcccctgcgagacaccacccttcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39750 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccaccgcactgcttcaaacgctccacccctcgctccttctcctacctcctcttcgacatcctcgtctcctcctccctctaccacctctccacagcctacttccctctcctcccccgccctctcccttacctcgcctggcccctctactgggcctgccaaggctgcgtcctaaccggcgtctgggtcatagcccacgagtgcggccaccacgccttcagcgactac

SEQ ID NO: 39751 - DNA, 332 bp, Artificial
  Mutation in BnaC.FAD2.b introduced by TALE nuclease pair BnFAD2_T03
caggatcctgggtgcaggtggaagaatgcaagtctctcctccctccagctcccccggaaccaacaccctcaaacgcgtcccctgcgagacaccaccattcactgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39752 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39753 - DNA, 355 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 39754 - DNA, 320 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacacacctcaagaaagcaatcccacctcactgcttcaaacgctcgatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39755 - DNA, 343 bp, Artificial
  Mutation in BnaC.FAD2.b introduced by TALE nuclease pair BnFAD2_T03
caggatccatgggtgcaggtggaagaatgcaagtctctcctctcttcagctcccccgaaaccaaaaccctcaaacgcgtcccccgcgagacaccacccttcactcgagacctcaagaaagcaatcccacctcactgcttcaaacgctccatcccacgctccttctcctcttcgacatcctcgtctcctcctccctctaccacctctccacagcctacttccctctcctcccccaccctctcccttacctcgccgggcccctctactgggcctgccaaggctgcgtcctaacgggcctctgggtcatcgcccacgaatgcggccagcacgcctgcagcgactac

SEQ ID NO: 39756 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgtggccaccacgccttcagcgactac

SEQ ID NO: 39757 - DNA, 317 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39758 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 39759 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctaccaaggctgtgtcctaacgggcctctgggtcatcgcccacgaatgcggccaccacgccttcagcgactac

SEQ ID NO: 39760 - DNA, 346 bp, Artificial
  Mutation in BnaC.FAD2.b introduced by TALE nuclease pair BnFAD2_T03
caggatccatgggtgcaggtggaagaatgcaagtttctactcccttccgctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgctgccaccacgccttcagcgactac

SEQ ID NO: 39761 - DNA, 293 bp, Artificial
  Mutation in BnaC.FAD2.b introduced by TALE nuclease pair BnFAD2_T03
caggatccatgggtgcaggtggaagaatgcaagtctctcctccctccagctcccccggaaccaagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 39762 - DNA, 420 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccgactgagcctttcgttttatctgttgtttgtcggtgaacgctctcctgagtaggacaaatccgccgggagcggatttgaacgttgtgaagcaacggcccggagctatttcattgtttcaaacgctccatcccacgctccttctcctcttcgacaccatcatctcctcctcggctcctccctctcccacctctccccagcctacttccctctcccttacctcgcctgacccctctactgggcctgccaaggctgcgtcctaacgggcctctgggtcatagcccacgagtgcggccaccacgccttcagcgactac

SEQ ID NO: 39763 - DNA, 349 bp, Artificial
  Mutation in BnaC.FAD2.b introduced by TALE nuclease pair BnFAD2_T03
caggatccatgggtgcaggtgaaagaatgcaagtctctactccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39764 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaaacgcgtcccctgttatcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 39765 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 39766 - DNA, 280 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 39767 - DNA, 406 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaacaccctcaaacgcgtcccctgcgagacaccaccattcactctcgacgctcaagtcagaggtggcgaaacccgacaggactataaagataccaggcgttagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39768 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttccctcgcctggcccctctactgggcctgccaatgctgcgtcctaacgggcctctgggtcatcgcccacgaatgcggccaccacgccttcagcgactac

SEQ ID NO: 39769 - DNA, 334 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcacacctcaagaaagcaatcccacctcactccttcaaacgctccatccctccctccttctcctacctcctcttcgacatcctcttctcctcctccctctcccacctctcccccgcctccttccctctcccttacctcgcctgacccctctactgggcctgccaaggctgcgtcctaacgggcctctgggtcatagcccacgagtgcggccaccacgccttcagcgactac

SEQ ID NO: 39770 - DNA, 328 bp, Artificial
  Mutation in BnaC.FAD2.b introduced by TALE nuclease pair BnFAD2_T03
caggatccatgggtgcaggtgaaagaatgcaagtctctcctccctccagctcccccggaaccaacaccctcaaacgcgtcccctgcgagacaccaccattcactcaagaaagcaatcccacctcactgcttcaaacgctccatcccccgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39771 - DNA, 329 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctcggaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39772 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 39773 - DNA, 335 bp, Artificial
  Mutation in BnaC.FAD2.b introduced by TALE nuclease pair BnFAD2_T03
caggctccatgggtgcaggtggaagaatgcatgtctctcctccctcccgctcccccggaaccaacaccctcaaacgcgtcccctgcgcgacaccaccattcactcagacctcaagaaagcaatcccacctcactgcttcaaacgctccatcccacgctccttctcctcttcgccatcatcatctcctcctcgcctcctccctctaccacctctccccagcctacttccctctcccttacctcgcctgacccctctactgggcctgccaaggctgcgtcctaacgggcctctgggtcatagcccacgagtgcggccaccacgccttcagcgactac

SEQ ID NO: 39774 - DNA, 343 bp, Artificial
  Mutation in BnaC.FAD2.b introduced by TALE nuclease pair BnFAD2_T03
caggacccatgggtgcaggtgaaagaatgcaagtacctcccccatccagctcccccgaaaccaaaaccctcaaagccgtccccggcgagacaccacccttccctcaagaaagcaatcccacctcacagcttcaaacgcgccatcccacgctccttctccgcttctacatcatcatctcctccgcggcccctcccactaccacctctccacagcctacttccctctcctccccccccctcacccttccctcccctggcccctctacagggcctgccaaggcggcgtcctaacgggcccctgggtcatcgcccacgaatgcggccaccacgccatcagcgactac

SEQ ID NO: 39775 - DNA, 336 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 39776 - DNA, 450 bp, Artificial
  Mutation in BnaC.FAD2.b introduced by TALE nuclease pair BnFAD2_T03
caggatccatgggtgcaggtggaagaatgcaagtctctcctccctccagctccaccggaaccaacaccctcaaacgcgtcccctgcgagacaccaccattcactctcgggtgttggcttaacgcaacgatgtgcgcgtgtgtaaacccgtggccgaccagtgcctcgtggtgcaggtggtggccatcgccagccacgatggcggcaagcaggcgctggagagacctcaagaaagcaatcccacctcactgcttcaaacgctccaccccacgctccttctcctcttcgacatcatcatctcctcctcggctcctccctctaccacctctccacagcctacttccctctcccttacctcgcctgacccctctactgggcctgccaaggctgcggcctaacgggcctctgggtcatagcccacgagtgcggccaccacgccttcagcgactac

SEQ ID NO: 39777 - DNA, 313 bp, Artificial
  Mutation in BnaC.FAD2.b introduced by TALE nuclease pair BnFAD2_T03
caggatacatgggtgcaggtggaagaatgcaagtgtctcctccctccaagaagtctgaaaccgacaacatcaagcgcgtaccctgcgagacatcaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39778 - DNA, 357 bp, Artificial
  Mutation in BnaC.FAD2.b introduced by TALE nuclease pair BnFAD2_T03
caggatccatgggtgcaggtggcagaatgcaagtctctaacccctccagctcccccgaaaccaaaaccctcaaacgcgtcccctgcgagacaccacccttcactctcggcctttttacggttcctctccctcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggccggccatggctgcggccggacgggcctcggggtcttcgcccacgagtgcgtccaccgcgccttcagcgactac

SEQ ID NO: 39779 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 39780 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctgacgggcctctgggtcctagcccacgagtgcggccaccacgccatcagcgactac

SEQ ID NO: 39781 - DNA, 419 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggaccgtctccagcgcctgcttgccaccgccattgctggcgatggccaccacctgctggggggtcaagccgtgggcctggcggagacctcaagaaagcaatcccacctcactgcttcaaacgctccatccctcgctccttctcctccctcctctccgacatcctcgtctcctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39782 - DNA, 347 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggccggccaaggctgcgtcctaacgggcctctgggtcatagcccacgagtgcggccaccacgccttcagcgactac

SEQ ID NO: 39783 - DNA, 331 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39784 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagatgtctgaaaccgacaccatcaagcgcgtaccctgcgagacaccgcccttcactgagaactcaagaaagcaatcccaccgcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaaggcggccaccacgccgtcagcgactac

SEQ ID NO: 39785 - DNA, 312 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcacttgacctcaagaaagcaatcccacctcactgcttcaaacgctccatcccacgctccttctcctcttcgacatcatcatctcctcctcggctcctccctcaccctctctcctacttcgcctggcctctctactgggcctgccagggctgcgtcctaaccggcgtctgggtcatagcccacgagtgcggccaccacgccttcagcgactac

SEQ ID NO: 39786 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39787 - DNA, 342 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgcctgcagcgactac

SEQ ID NO: 39788 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaacgctccatcccacgctccttctcctcttcgacatcatcatctcctcctctgctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39789 - DNA, 313 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39790 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctacctcctcttcgacatcctcgtctcctcctccctctaccacctctccacagcctacttccctctcatccaccaccctctcccttacctcgcctggcccctctactgggcctgccaaggctgcgtcctaacgggcctctgggtcatagcccacgagtgcggccaccacgccttcagcgactac

SEQ ID NO: 39791 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgtgagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39792 - DNA, 340 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtactcaagaaagcaatcccaccgcactgtttcaaacgctcgatccctcgctctttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39793 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 39794 - DNA, 346 bp, Artificial
  Mutation in BnaC.FAD2.b introduced by TALE nuclease pair BnFAD2_T03
caggatccatgggtgcaggtggaagaatgcaagtctctcctccctcccgctcccccgaaaccaaaaccctcaaccgcgtccactgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgtgcctctgggtcatcgcccacgaatgcggccaccacgccttcagcgactac

SEQ ID NO: 39795 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39796 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgtgtcatagcccacgagtgcggccaccacgccttcagcgactac

SEQ ID NO: 39797 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcgacctcaagaaagcaatcccacctcactgcttcaaacgctccatcccacgctccttctcctacctcctcttcgacatcctcgtctcctcctccctctaccacctctccacagcctactttcctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39798 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaaagcaatcccacctcactgcttcaaacgctccatccctcgctccttctcctacctcctcttcgacatcctcgtctcctcctccctctaccacctcgccacagcctacttccctctcctcccccaccctcccccttacctcgcctggcccctctactgggcctgccaaggctgcgtcctaacgggcctctgggtcatagcccacgaatgcggccaccacgccttcagcgactac

SEQ ID NO: 39799 - DNA, 350 bp, Artificial
  Mutation in BnaC.FAD2.b introduced by TALE nuclease pair BnFAD2_T03
caggatccatgggtgcaggtgcaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctgacccctctactgggcctgccagggctgcgtcctaaccggcgtctgggtcatagcccacgagtgcggccaccacgccttcagcgactac

SEQ ID NO: 39800 - DNA, 349 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccacccttcactaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 39801 - DNA, 308 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39802 - DNA, 340 bp, Artificial
  Mutation in BnaC.FAD2.b introduced by TALE nuclease pair BnFAD2_T03
caggatccatgggtgcaggtggcagaatgcaagtgtctcctccctcccgctcccccgaaaccaaaaccctcaaacgcgtcccctgcgagacaccaccgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39803 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtccgaacgggcctctgggtcatcgcccacgaaggcggccaccacgccttcagcgactac

SEQ ID NO: 39804 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaaggctgcgtcctaacgtgcctctgggtcatagcccacgagtgcggccaccacgccttcatcgactac

SEQ ID NO: 39805 - DNA, 294 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaagaaagcaatcccacctcactgcttcaaacgctccattccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39806 - DNA, 342 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggtcaccacgccttcagcgactac

SEQ ID NO: 39807 - DNA, 328 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcaagaaagcaatcccacctcactgcttcaaacgctccatcccacgctccttctcctcttctacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39808 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 39809 - DNA, 461 bp, Artificial
  Mutation in BnaC.FAD2.b introduced by TALE nuclease pair BnFAD2_T03
caggatccatgggtgcaggtggaagaatgcaagtgtctcctccctccaagaagactgaaaccgacaacatcaagcgcgtaccctgcgagacaccgcccttcactgttaggcgacttttgaacgcgcaataatggtttctgacgtatgtgcttgcccacggcttgaccccggagcaggtggtggccatcgccagccacgatggggcgctggcaagtgtagtggttacgcgcaagacctcaagaaagcaatcccacctcactgcttcaaacgctccatcccacgctccttctcctcttcgacaccatcatctcctcctcggctcctccctctaccgcctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39810 - DNA, 335 bp, Artificial
  Mutation in BnaC.FAD2.b introduced by TALE nuclease pair BnFAD2_T03
caggatccatgggtgcaggtggaagaatgcaagtctctcctccctcccgctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggttgcgtcctaacgggcgtctgggtcatagcccacgagtgcggccaccactcctgcagcgactac

SEQ ID NO: 39811 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39812 - DNA, 317 bp, Artificial
  Mutation in BnaC.FAD2.b introduced by TALE nuclease pair BnFAD2_T03
caggatccatgggtgcaggtggaagaatgcaagtatatcctccctccagctcccccgaaaccaaaaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctctcctacttcgcctggcctctctactgggcctgccaagggtgcgtcctaaccggggtctgggtcatagcccacgagtgcggccaccacgccttcagcgactac

SEQ ID NO: 39813 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggccactctactgggcctgccaaggctgcgtcctaacgggcctctgggtcatcgcccacgaatgcggccaccacgccttcagcgactac

SEQ ID NO: 39814 - DNA, 363 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcggcgggggtggtggttacgcgcaaagacctcaagaaagcaatcccacctcactgcttcaaacgctccatcccacgctccttctcctcttcgacatcatcatctcctcctcggctcctccctctaccacctctccacagcctacttccctcgcccttacctcgcctgacccctctactgggcctgccaaggctgcgtcctaacgggcctctgggtcatagcccacgagtgcggccaccacgcctgcagcgactac

SEQ ID NO: 39815 - DNA, 379 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcttgaacgctctcctgagtaggacaaatccgctccctcaagaaagcaatcccacctcactgcttcaaacgctccatccctcgctccttctcctacctcctcttcgacatcctcgtctcctcctccctctaccacctctccacagcctacttcccgctcctcccccaccctcgccctgacctcgcctggcccctctactgggcctgccaaggctgcgtcctaacgggcctctgggtcatcgcccacgaatgcggccaccacgccttcagcgactac

SEQ ID NO: 39816 - DNA, 379 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggtggtggccatcgccagcaatattggtggcaagcaggcgctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39817 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgtagacctcaagaaagcaatcccacctcactgcttcaaacgctccatccctcgctccttctcctacctcctcttcgacatcctcgtctcctcctccctctaccacctctccacagcctacttccctctcctcccccacccgctcccttacctcgcctggcccctctactgggcctgccaaggctgcgtcctaacgggcctctgggtcatagcccacgagtgcggccaccacgccttcagcgactac

SEQ ID NO: 39818 - DNA, 335 bp, Artificial
  Mutation in BnaC.FAD2.b introduced by TALE nuclease pair BnFAD2_T03
caggatccatgggtgcaggagccagaatgcaagtgtcacctagctccagctcccccggaaccaacaacctcaaacgcgtcccctgcgagacaccaccattcactcttacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggcggcggcctaacgggcctcttggtcagatcccacgagtgcggcctccacgccttcagcgactac

SEQ ID NO: 39819 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 39820 - DNA, 334 bp, Artificial
  Mutation in BnaC.FAD2.b introduced by TALE nuclease pair BnFAD2_T03
caggatccatgggtgcaggtggaagaatgcaagtctctcctccctcccgcacctccggaaccaacaccctcaaccgcgtcccctgctagacaccaccattcactctaccacaagacaacaatcccacctcactgcaccaaacgctccctcccaccctccttcccctcttcgacatcatcatctcctcctccgctcctccccctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39821 - DNA, 421 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcctacaccgctgtgaagtgctccaccccgtaggtcggataaggcggttacgccttatcccacctacggagacctcaagaaagcaatcccacctcactgcttcaaacgctccatccctcgctccttctcctacctccccttcgacatcctcgtcccctcctccctctaccacctctccacagcctacttccctctcctcccccaccctctcccttacctcgcctggcccctctactgggcctgccaaggcagcgtcctaacgggcctctgggtcatagcccacgagtgcggccaccacgccttcagcgactac

SEQ ID NO: 39822 - DNA, 269 bp, Artificial
  Mutation in BnaC.FAD2.b introduced by TALE nuclease pair BnFAD2_T03
caggatccatgggtgcagggggcagaatgcaagtttctactccctcaagaaagcaatcccaccgcactgcttccaacgctccagcccacgctccttctcctcttcgacaacatcatctcctcctcggctcctccctctcccacctctccacagcctacttccctcgcccttacctcgcctgacccctctactgggcctgccaaggctgcgtcctaacgggcctctgggtcatagcccacgagggcggccaccactccttcagcgactac

SEQ ID NO: 39823 - DNA, 342 bp, Artificial
  Mutation in BnaC.FAD2.b introduced by TALE nuclease pair BnFAD2_T03
caggatccatgggtgcaggttgaagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39824 - DNA, 320 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccaccattcactctatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39825 - DNA, 331 bp, Artificial
  Mutation in BnaC.FAD2.b introduced by TALE nuclease pair BnFAD2_T03
caggatccatgggtgcaggtggaagaatgcaagtctctactcactccagctcccccggaaccaacaccctcaaacgcgtcccctgcgagacaccacccttcactccctcaagaaagcaatcccacctcactgcttcacaccctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39826 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcggcctaacgggcctctgggtcatagcccacgagtgcggccaccacgccttcagcgactac

SEQ ID NO: 39827 - DNA, 306 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 39828 - DNA, 337 bp, Artificial
  Mutation in BnaC.FAD2.b introduced by TALE nuclease pair BnFAD2_T03
caggatccataggtgcaggtggaagaatgcaagtctctcctccctccagctcccccggaaccaacaccctcaaacgcgtcccctgcgagacaccaccattcactctcgaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39829 - DNA, 337 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcagaactcaagaaagcaatcccacctcactgcttcaaacgctccatcccacgccccttctcctcttcgacatcatcatctcctcctcggctcctccctctaccacctctccacagcctacttccctctcccttacctcgcctgacccctctactgggcctgtcaaggctgcgtcctaacgggcgtctgggtcatagcccacgagtgcggccaccacgccttcagcgactac

SEQ ID NO: 39830 - DNA, 265 bp, Artificial
  Mutation in BnaC.FAD2.b introduced by TALE nuclease pair BnFAD2_T03
caggatccatgggtgcaggtggcagaatgcaagtctctcctccctccagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39831 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttcttctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39832 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaacaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 39833 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcggcctaacgggcctctgggtcatagcccacgagtgcggccaccacgccttcagcgactac

SEQ ID NO: 39834 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcttcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39835 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39836 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgtggccaccacgccttcagcgactac

SEQ ID NO: 39837 - DNA, 334 bp, Artificial
  Mutation in BnaC.FAD2.b introduced by TALE nuclease pair BnFAD2_T03
cagtatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39838 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 39839 - DNA, 351 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 39840 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgctac

SEQ ID NO: 39841 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccgccattcactcagacctcaagaaagcaatcccacctcactgcttcaaacgctccatccaacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39842 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctacgagacaccaccattcactcggacctcaagaaagcaatcccacctcactgcttcaaacgctccatcccacgctccttctcctcttcgacatcatcatctcctcctcggctcctccctctaccacctctccacagcctacttccctctcccttacctcgcctgaccactctactgggcctgccaaggctgcgtcctaacgggcctctgggtcatagcccacgagtgcggccaccacgccttcagcgactac

SEQ ID NO: 39843 - DNA, 351 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgcctttcagcgactac

SEQ ID NO: 39844 - DNA, 334 bp, Artificial
  Mutation in BnaC.FAD2.b introduced by TALE nuclease pair BnFAD2_T03
caggatccatgggtgcaggtgcaagaatgcaagtgtctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39845 - DNA, 334 bp, Artificial
  Mutation in BnaC.FAD2.b introduced by TALE nuclease pair BnFAD2_T03
caggatccatgggcgcaggtggaagaatgcaagtctctcctccctccagctcccccggaaccaacaccctcaaacgcgtcccctgcgagacaccaccattcacttgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39846 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacggacctctgggtcatcgcccacgaatgcggccaccacgccttcagcgactac

SEQ ID NO: 39847 - DNA, 343 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctatactgggcctgccaaggctgcgtcctaacgggcctctgggtcatcgcccacgaatgcggccaccacgccttcagcgactac

SEQ ID NO: 39848 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39849 - DNA, 356 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcgggggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39850 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 39851 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatttcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccatggctgcgtcctaaccggcgtctgggtcatagcccacgagtgcggccaccacgccttcagcgactac

SEQ ID NO: 39852 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 39853 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 39854 - DNA, 347 bp, Artificial
  Mutation in BnaC.FAD2.b introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgactggcccctctactgggcctgccaagggtgcgtcctaaccggcgtctgggtcatagcccacgagtgcggccaccacgccttcagcgactac

SEQ ID NO: 39855 - DNA, 336 bp, Artificial
  Mutation in BnaC.FAD2.b introduced by TALE nuclease pair BnFAD2_T03
caggatccatgggtgcaggtgcaagaatgcaagtgtctcctccctccaagaagtctgaaaccgacaccatcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39856 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 39857 - DNA, 336 bp, Artificial
  Mutation in BnaC.FAD2.b introduced by TALE nuclease pair BnFAD2_T03
caggatccatgggtgcaggtggaagaatgcaagtctctcctccctcgagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39858 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 39859 - DNA, 348 bp, Artificial
  Mutation in BnaC.FAD2.b introduced by TALE nuclease pair BnFAD2_T03
caggatccatgggtgcaggtggaagaatgcaagtctatcctccctccagctcccccgtaaccaacaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctggcccctctactgggcctgccaaggctgcttcctaacgggcctctgggtcatagcccacgagtgcggcctccacgccttcagcgactac

SEQ ID NO: 39860 - DNA, 397 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggagcaggttgtggccatcgccagccatattggtggcaagcaggcgctggagacggtgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39861 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39862 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 39863 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccaccgcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 39864 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccctggcgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 39865 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggcggcgtcctaacgggcctctgggtcatcgcccacgaatgcggccaccacgccttcagcgactac

SEQ ID NO: 39866 - DNA, 292 bp, Artificial
  Mutation in BnaC.FAD2.b introduced by TALE nuclease pair BnFAD2_T03
caggatccatgggtgcaggtggcagaatgcaagtctctactccctccagctcccccgaaaccaaaaccctcaaacgcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaagggtgcggcctaaccagcgtctgggtcatagcccacgagtgcggccaccacgcctgcagcgactac

SEQ ID NO: 39867 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39868 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaggacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39869 - DNA, 329 bp, Artificial
  Mutation in BnaC.FAD2.b introduced by TALE nuclease pair BnFAD2_T03
caggatccatgggtgcaggtggaagaatgcaagtttctcctccctccagctcccccgaaaccaaaaccctcaaacgcgtcccctgcgagacaccacccttagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39870 - DNA, 389 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttggcggcggcaggccggcgctggagagcattgttgcccagttatctcgccctgatccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39871 - DNA, 300 bp, Artificial
  Mutation in BnaC.FAD2.b introduced by TALE nuclease pair BnFAD2_T03
caggatccatgggtgcaggtggaagaatgcaagtctctcctccctccagctcccccggaaccaagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39872 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 39873 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccaagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccatggctgcgtcctaaccggcgtctgggtcatagcccacgagtgcggccaccacgccttcagcgactac

SEQ ID NO: 39874 - DNA, 407 bp, Artificial
  Mutation in BnaC.FAD2.b introduced by TALE nuclease pair BnFAD2_T03
caggatccatgggtgcaggtggaagaatgcaagtgtctcctccctccagcccccccggaaccaacaccctcaaacgcgtcccctgcgagacaccaccattcactctctccagcgcctgcttgccaccattattgctggcgatggccaccacctgctggggggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39875 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacaagacctcaagaaagcaatcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 39876 - DNA, 278 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39877 - DNA, 334 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39878 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggccggccaaggctgcgtcctaacgggcctctgggtcatcgcccacgaaggcggccaccacgccaacagcgactac

SEQ ID NO: 39879 - DNA, 266 bp, Artificial
  Mutation in BnaC.FAD2.b introduced by TALE nuclease pair BnFAD2_T03
caggatccatgggtgcaggtggaagaatgcaagtctcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 39880 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctctttgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39881 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccacggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39882 - DNA, 351 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39883 - DNA, 363 bp, Artificial
  Mutation in BnaC.FAD2.b introduced by TALE nuclease pair BnFAD2_T03
caggatccatgggtgcaggtggaagaatgcaagtctctcctccctccagctccaccgaaaccaaaaccctcaaacgcgtcccctgcgagacaccacccttcactctcctttctttctggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39884 - DNA, 295 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 39885 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctcaacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39886 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactgagacctcaagaaagcaatcccacctcactgcttcaaacgctccctcccaccctccttctcctcttcgccatcatcatctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 39887 - DNA, 328 bp, Artificial
  Mutation in BnaC.FAD2.b introduced by TALE nuclease pair BnFAD2_T03
caggatccatgggtgcaggtggaagaatgcaagtgtctcctccatccaagaagtctgaaaccgacaccatcaagcgcgtaccctgcgagacaccgcccttcactgaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39888 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39889 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39890 - DNA, 350 bp, Artificial
  Mutation in BnaC.FAD2.b introduced by TALE nuclease pair BnFAD2_T03
caggatccatgggtgcaggtggcagaatgcaagtctctcatccctccagctcccccggaaccaacaccctcaaacgcgtcccctgcgagacaccacccttcactctcggcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 39891 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39892 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39893 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcacacctcaagaaagcaatccaacctccctccttcaaacgctccatcccaccctccttctcctcttcgacttcaccatctcctcctcggctcctccctctaccacctctccacagcccactaccctctcccttacctcgcctggcccctctactgggcctgccaaggctgcgtcctaacgggcgtctgggtcatagcccacgagtgcggccaccacgccttcagcgactac

SEQ ID NO: 39894 - DNA, 351 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39895 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccccctcactgcttcaaacgctccatccctcgctccttctcctacctcctcttcgacatcctcgtctcctcctccctctaccacctctccacagcctacttccctctcctcccccaccctctcccttacctcgcctggcccctcaactgggcctgccaaggctgcgtcctaacgggcctctgggtcatcgcccacgaatgcggccaccacgccttcagcgactac

SEQ ID NO: 39896 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctaaaacgcgtcccctgcgagacaccaccattcactctccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39897 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctaaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccccagcctacttccctctcctcccccaccctctcccttacctcgcctggcctctctactgagcctgccaagggtgcggcctaaccggcgtctgggtcatagcccacgagtgcggccaccacgccatcagcgactac

SEQ ID NO: 39898 - DNA, 348 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactccacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39899 - DNA, 301 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcccggcccctctactgggcctgccaaggctgcgtcctaacgggcctctgggtcatcgcccacgaatgcggccaccacgccttcagcgactac

SEQ ID NO: 39900 - DNA, 320 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttagacctcaagaaagcaatcccacctcactgcttcaaacgctccatcccacgctccttctcctcttcgacatcatcatctcctcctcggctcctccctctaccacctctccacagcctacttcgcctggcctctctactgggcctgccagggctgcgtcctaaccggcgtctgggtcatagcccacgagtgcggccaccacgccttcagcgactac

SEQ ID NO: 39901 - DNA, 279 bp, Artificial
  Mutation in BnaC.FAD2.b introduced by TALE nuclease pair BnFAD2_T03
caggatccatgggtgcaggtggaagaatgcaagtctctcctccctccagtctctccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgacta

SEQ ID NO: 39902 - DNA, 350 bp, Artificial
  Mutation in BnaC.FAD2.b introduced by TALE nuclease pair BnFAD2_T03
caggatccatggtgcaggtggaagaatgcaagtgtctcctccctccaagaagtctgaaaccgacaccatcaaacgcgtcccctgcgagacaccacccttcactctaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39903 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 39904 - DNA, 328 bp, Artificial
  Mutation in BnaC.FAD2.b introduced by TALE nuclease pair BnFAD2_T03
caggagccatgggtgcaggtggaagaatgcaagtctctcctccctccagctcccccggaaccaacaccctcaaacgcgtcccctgcgagacaccaccaagacctcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccacggctgcgtcctaaccggcgtctgggtcatagcccacgagtgcggccaccacgccttcagcgactac

SEQ ID NO: 39905 - DNA, 322 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39906 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcctctctactgggcctgccagggctgcgtcctaacgggcctctgggtcatagcccacgagtgcggccaccacgccttcagcgactac

SEQ ID NO: 39907 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacacctcaagaaagcaatcccacctccctgcttcaaaccctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 39908 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctccatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 39909 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39910 - DNA, 345 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 39911 - DNA, 403 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccaccattcactctagatcggcgatatcgatgctgtccatgtgctgtctctcgaacttggcagcggcagtctccttatcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39912 - DNA, 350 bp, Artificial
  Mutation in BnaC.FAD2.b introduced by TALE nuclease pair BnFAD2_T03
caggatccatgggtgcagggggcagaatgcaagtttcttctcccttcagctcccccgaaaccaaaacactcaaccgcgtcccctgagagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggccggccaatgcggcgtcctaactggcctctggttcatcgccctcgaagtcggccgctactccttcatcgactac

SEQ ID NO: 39913 - DNA, 331 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39914 - DNA, 294 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaagaaagcaatcccacctcactgcttcaaacgctccatcccacactccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39915 - DNA, 326 bp, Artificial
  Mutation in BnaC.FAD2.b introduced by TALE nuclease pair BnFAD2_T03
caggatccatgggtgcaggtggcagaatgcaagtctctactccctccagctcccccggaaccaacaccctcaaacgcgtcccctgcgagacaccaccattctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39916 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatccaacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39917 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 39918 - DNA, 350 bp, Artificial
  Mutation in BnaC.FAD2.b introduced by TALE nuclease pair BnFAD2_T03
caggatccatgggtgcaggtggcagaatgcaagtttctcctccctccagctcccccgaaaccaaaaaactcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39919 - DNA, 335 bp, Artificial
  Mutation in BnaC.FAD2.b introduced by TALE nuclease pair BnFAD2_T03
caggatccatgggtgcaggtggcagaatgcaagtgtctcctccctccagctcccccggaaccaacaccctcaaacgcgtcccctgcgagacaccaccattcactcaagaaagcaatcccacctcactgcctcaacagcgccatcccacgctccttctcctcttcgacatcctcgtcgcctcctccctctaccacctctccacagcctacttccctctccccccccaccctctcccttacctcgcctggcccctctactgggcctgccaaggctgcgtcctaacgggcctctgggtcatcgcccacgaatgcggccaccacgccttcagcgactac

SEQ ID NO: 39920 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39921 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39922 - DNA, 423 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctctccagcggctgttgccggtgctgtgccaggcccacggcttgaccccccagcaggtggtggccatcgccagcgagacctcaagaaagcaatcccacctcactgcttcaaacgctccatccctcgctccttctcctacctcctcttcgacatccccgtcccctcctccctctaccacctctccacagcctacttccctctcctcccccaccctctcccctacctcgcctggcccctctactgggcctgccaaggctgcgtcctaacgggcctctgggtcatcgcccacgaatgcggccaccacgccttcagcgactac

SEQ ID NO: 39923 - DNA, 373 bp, Artificial
  Mutation in BnaC.FAD2.b introduced by TALE nuclease pair BnFAD2_T03
caggatccatgggtgcaggtggaagaatgcaagtctctcctccctcccgctcccccggaaccaacaccctcaaacgcgtcccctgcgagacaccaccattcactatgcgttatcccctgattctgtggataaccgtattaccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39924 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39925 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 39926 - DNA, 334 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaccgcgtcccctgcgagacaccaccattcactcgacctcaagaaagcaatcccaccgcactgtttcaaacgctcgatccctcgctctttctcctcttcgacatcatcatctcctcctcggctcctccctctaccacctctccccagcctacttccctctcccttacctcgcctgacccctctacggggcctgccaaggctgcgtcctaacgggcctctgggtcatagcccacgagtgcggccaccacgccttcagcgactac

SEQ ID NO: 39927 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 39928 - DNA, 348 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 39929 - DNA, 373 bp, Artificial
  Mutation in BnaC.FAD2.b introduced by TALE nuclease pair BnFAD2_T03
caggatccatgggtgcaggtggcagaatgcaagtctctactccctccagctcccccggaaccaacaccctcaaacgcgtcccctgcgagacaccgcccttcacattaaccagctgcattaatgaatcggccaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39930 - DNA, 347 bp, Artificial
  Mutation in BnaC.FAD2.b introduced by TALE nuclease pair BnFAD2_T03
caggatccatgggtgcaggtgcaagaatgcaagtctctcctccctccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39931 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39932 - DNA, 331 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39933 - DNA, 336 bp, Artificial
  Mutation in BnaC.FAD2.b introduced by TALE nuclease pair BnFAD2_T03
caggatccatgggtgcaggtgccagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcggcctaacgggcctctgggtcatagcccacgagtgcggccaccacgccatcagcgactac

SEQ ID NO: 39934 - DNA, 336 bp, Artificial
  Mutation in BnaC.FAD2.b introduced by TALE nuclease pair BnFAD2_T03
caggatccatgggtgcaggtggcagaatgcaagtctctactccctcaagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39935 - DNA, 397 bp, Artificial
  Mutation in BnaC.FAD2.b introduced by TALE nuclease pair BnFAD2_T03
caggatccatgggtgcaggtggaagaatgcaagtctctcctccctcccgctcccccggaaccaacaccctcaaacgcgtcccctgcgagacaccaccattcactctcggcaccggcaacagccgctggaccgtctccagcgcctgcttgccaccagagacctcaagaaagcaatcccacctcactgcttcaaacgctccatccctcgctccttctcctacctcctcttcgacatcctcgtctcctcctccctcgaccacctctccacagcctacttccctcgccccccccaccctcccccttacctcgcctggcccctctactgggcctgccaaggctgcgtcctaacgggcctctgggtcaccgcccacgaatgcggccaccacgccttcagctac

SEQ ID NO: 39936 - DNA, 466 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggttctgagggtggcggctctgagggtggcggcactaatcctcctgagtacggtgataccccttgatcatgagcggagaattaagggaatacgtctccagcgcctgcttgccaccgccattgctggcgaagacctcaagaaagcaatcccacctcactgcttcaaacgctccaccccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccactagtgcggccaccacgccttcagcgactac

SEQ ID NO: 39937 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagccaccacccttcactctaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 39938 - DNA, 334 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39939 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccacctcactgcttcaaacgctccctcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39940 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtcttggtcagagcccacgagtgcggccaccacgccttcagcgactac

SEQ ID NO: 39941 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccagggctgcgtcctaacgggcctctgggtcatagcccacgagtgcggccaccacgccttcagcgactac

SEQ ID NO: 39942 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39943 - DNA, 349 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 39944 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39945 - DNA, 288 bp, Artificial
  Mutation in BnaC.FAD2.b introduced by TALE nuclease pair BnFAD2_T03
caggatccatgggtgcaggtggaagaatgcaagtctctcatccctccaggtagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 39946 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccatcacgccttcagcgactac

SEQ ID NO: 39947 - DNA, 333 bp, Artificial
  Mutation in BnaC.FAD2.b introduced by TALE nuclease pair BnFAD2_T03
caggatccatgggtgcaggtgcaagaatgcaagtgtctcctcccttcaagaagtctgaaaccgacaccatcaagcgcgtaccctgcgagacaccgcccttcactgaactcaagaaagcaatcccacctcactgcttcaaacgctccatcccacgctccttctcctcttctacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 39948 - DNA, 279 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcatcccctgcgagacaccacccttcactcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39949 - DNA, 335 bp, Artificial
  Mutation in BnaC.FAD2.b introduced by TALE nuclease pair BnFAD2_T03
caggatccatgggtgcaggtggcagaatgcaagtgtctcctccctccagctcccccggaaccaacaccctcaaacgcgtcccctccgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39950 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 39951 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaagcgcgtaccctgcgagacaccgcccttcactgtagaactcaagaaagcaatcccaccgcactgtttcaaacgctcgatcccacgctccttctcctcttcgacatcatcatctcctcctcggctcctccctctaccacctctccacagcctacttccctctcctcccccaccctctcccttacctcgcctggcccctctactgggcctgccaagggtgcgtcctaacgggcctctgggtcatagcccacgagtgcggccaccacgccttcagcgactac

SEQ ID NO: 39952 - DNA, 371 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgtcgggtcagggtgccggccttgatcatctcgccgccagaactcaagaaagcaatcccaccgcactgcttcaaacgctccatcccacgctccttctcctcttcgacatcatcatctcctcctcggctcctccctctaccacctctccgcagcctacttccctctcccttacctcgcctggcccctctactgggccttccaaggctgcgtcctaacgggcctctgggtcatagcccacgagtgcggccaccacgccttcagcgactac

SEQ ID NO: 39953 - DNA, 349 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcagacctcaagaaagcaatcccacctccctgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgcgtcatagcccacgagtgcgtcctccacgccttcagcgactac

SEQ ID NO: 39954 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctgacccctctactgggcctgccaaggctgcgtcctaacgggcctctgggtcatagcccacgagcgcggccaccacgccttcagcgactac

SEQ ID NO: 39955 - DNA, 435 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggtccagcggctgttgccggtgctgtgccaggcccacggcttgaccccccagcaggtggtggccatcgccagcaatggcggtggcaagcaggcgctggagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39956 - DNA, 395 bp, Artificial
  Mutation in BnaC.FAD2.b introduced by TALE nuclease pair BnFAD2_T03
caggatccatgggtgcaggtggaagaatgcaagtctctcctccctccagctcccccggaaccgacaccatcaagcgcgtaccctgcgagacaccgccccccaccttcagcccggaccagaaagcaaccacagcccaccactacaaacgcaacagcccccgcaccgacacctcaagaaagcaatcccacctcactgcttccaacgctccatcccaccctccttccccccttccacatcatcatctcctcctcgcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39957 - DNA, 351 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcgagacctcaagaaagcaatcccccctcactgcttcaaacgctccatcccacgctccttctcctcttcgccatcatcatctcctcctcgcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 39958 - DNA, 354 bp, Artificial
  Mutation in BnaC.FAD2.b introduced by TALE nuclease pair BnFAD2_T03
caggatccatgggtgcaggcggaagaatgcaagtgtctcatcactccaagaagtctgaaaccgacaccatcaagcgcgtaccctgcgagacaccacccttcactctcgggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcgtccaccacgccttcagcgactac

SEQ ID NO: 39959 - DNA, 349 bp, Artificial
  Mutation in BnaC.FAD2.b introduced by TALE nuclease pair BnFAD2_T03
caggatccatgggtgcaggtggcagaatgcaagtgtctcctccctccagctcccccgaaaccaaaaccatcaaacgcgtcccctgcgagacaccacccttcactaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 39960 - DNA, 345 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcacacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgtcaagggtgcgtcctaacgggcctctgggtcatagcccacgagtgcggccaccacgccttcagcgactac

SEQ ID NO: 39961 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcgtctgaaaccgacaccctcaaacgcgtcccctgcgagacaccacccttcactcgcgacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcgtctgggtcatagcccacgaatgcggccaccacgccttcagcgactac

SEQ ID NO: 39962 - DNA, 350 bp, Artificial
  Mutation in BnaC.FAD2.b introduced by TALE nuclease pair BnFAD2_T03
caggatccatgggtgcagggggaagaatgcaagtctctcctccctccagctcccccgaaaccaaaaccctcaaacgcgtcccctgtgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39963 - DNA, 336 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctacgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39964 - DNA, 409 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggctgcggcgagcggtatcagctcactcaaaggcggtaatacggttatccacagaatcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39965 - DNA, 342 bp, Artificial
  Mutation in BnaC.FAD2.b introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactcagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 39966 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcgatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39967 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 39968 - DNA, 331 bp, Artificial
  Mutation in BnaC.FAD2.b introduced by TALE nuclease pair BnFAD2_T03
caggatccatgggtgcaggtgccagaatgcaagtgtctcctcactccaagaagtctgaaaccgacaccatcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39969 - DNA, 322 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39970 - DNA, 335 bp, Artificial
  Mutation in BnaC.FAD2.b introduced by TALE nuclease pair BnFAD2_T03
caggatccatgggtgcaggtggcagaatgcaagtctctactccctccagctcccccgaaaccaaaaccctcaaacgcgtcccctgcgagacaccacccttcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39971 - DNA, 335 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39972 - DNA, 335 bp, Artificial
  Mutation in BnaC.FAD2.b introduced by TALE nuclease pair BnFAD2_T03
caggatccatgggtgcaggtggaagaatgcaagtctctcctccatccagctcccccgaaaccaaaaccctcaaacgcgtcccctgcgagacaccaccattcactctgacctcaagaaagcaatcccacctcactgcttcaaacgctccatccaacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39973 - DNA, 292 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaaagcaatcccacctcactgcttcaaacgctccatcccacgctccttctcctcttcgacatcatcatctcctcctaggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39974 - DNA, 336 bp, Artificial
  Mutation in BnaC.FAD2.b introduced by TALE nuclease pair BnFAD2_T03
caggatccatgggtgcaggtgaaagaatgcaagtctcaaatccctcaagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcggcctaacgggcctctgggtcatagcccacgagtgcggccaccacgccttcagcgactac

SEQ ID NO: 39975 - DNA, 346 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcaagacctcaagaaagcaatcccacctcactgcttcaaacgctccatccctcgctccttctcctacctcctcttcgacatcctcgtctcctcctccctctaccacctctccacagcctacttccctctcctcccccaccctcgcccttacctcgcctggcccctctactgggcctgccaaggctgcgtcctaacgggcctctgggtcatcgcccacgaatgcggccaccacgccttcagcgactac

SEQ ID NO: 39976 - DNA, 337 bp, Artificial
  Mutation in BnaC.FAD2.b introduced by TALE nuclease pair BnFAD2_T03
caggatccatgggtgcaggtggaagaatgcaagtatctactcactccagctccaccggaaccaacacactaaaaagcgtcccctgcgagacaccaccattcactctaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctgactggcctctgggtcatagcccacgagtgcggccaccacgccttcagctactac

SEQ ID NO: 39977 - DNA, 350 bp, Artificial
  Mutation in BnaC.FAD2.b introduced by TALE nuclease pair BnFAD2_T03
caggatccatgggtgcaggtggaagaatgcaagtttctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39978 - DNA, 344 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39979 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 39980 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgacctcaagaaagcaatcccacctcactgcttcaaacgctccatcccacgctccttctcctcttcgacatcatcatctcctcctcggctcctccctctaacacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 39981 - DNA, 333 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccaccattcactctcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39982 - DNA, 334 bp, Artificial
  Mutation in BnaC.FAD2.b introduced by TALE nuclease pair BnFAD2_T03
caggatccatgggtgcaggtggaagaatgcaagtctctcatccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 39983 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39984 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtaatcgcccacgaatgcggccaccacgccttcagcgactac

SEQ ID NO: 39985 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatcccacgctccttctcctcttcgacatcatcatctcctcctcggctcctccctctaccacctctccacagcctacttccatctcccttacctcgcctgacccctctactgggcctgccaaggctgcgtcctaacgggcctctgggtcatagcccacgagtgcggccaccacgccttcagcgactac

SEQ ID NO: 39986 - DNA, 285 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39987 - DNA, 431 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaaacgcgtcccctgcgagacaccaccattcactctatctccagcggctgttgccaccgccattgctggcgatggccaccacctgctggggggtcaagttgagcggggcacccgtcagtgcattgcgccagagacctcaagaaagcaatcacacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39988 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacaagaaagcaatcccacctcactgcttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39989 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggacccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39990 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 39991 - DNA, 315 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgtagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggcggcgtcctaacgggcctctgggtcatagcccacgagtgcggccaccacgccttcagcgactac

SEQ ID NO: 39992 - DNA, 341 bp, Artificial
  Mutation in BnaC.FAD2.b introduced by TALE nuclease pair BnFAD2_T03
caggatccatgggtgcaggtggaagaatgcaagtctctcctccctccagctccccggaaccaacaccctcaaacgcgtcccctgcgagacaccacccttcactcagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 39993 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39994 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccccgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 39995 - DNA, 296 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccatcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39996 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccgccctctcccttacctcgcctggcccctctactgggccggccaaggcggcgtcctaacgggcctctgggtcatagcccacgagtgcggccaccacgcctgcagcgactac

SEQ ID NO: 39997 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaagggtgcgtcctaaccggcgtctgggtcatagcccacgagtgcggccaccacgccttcagcgactac

SEQ ID NO: 39998 - DNA, 368 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgagcgccatctcgaaccgacgttgctggccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 39999 - DNA, 346 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctgtaaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggtccctctactgggcctgccaaggctgcgtcctaacgggcctctgggtcatcgcccacgaatgcggccaccacgccttcagcgactac

SEQ ID NO: 40000 - DNA, 333 bp, Artificial
  Mutation in BnaC.FAD2.b introduced by TALE nuclease pair BnFAD2_T03
caggatccatgggtgcaggtggcagaatgcaagtgtctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcataggccacgagtgcggccaccacgccttcagcaactac

SEQ ID NO: 40001 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattctcaagaaagcaatcccacctcactgcttcaaacgctccatcccacgctccttctcctcttcgacatcatcatctcctcctcgactcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40002 - DNA, 337 bp, Artificial
  Mutation in BnaC.FAD2.b introduced by TALE nuclease pair BnFAD2_T03
caggatccatgggtgcaggtggaagaatgcaagtgtcccctccctccagctccaccgaaaccaaaaccctaaaacgcgtcccctgcgagacaccacccttaagaaagcaatcccacctcactgcttcaaacgctccatccctcgctccttctcctacctcctcttcgacatcctcgtctcctcctccctctaccacctctccacagcctacttccctcgccacccccaccctctcccttacctcgcctggcccctctactgggccggccaaggctgcgtcctaacgggcctctgggtcatcgcccacgaatgcggccaccacgcctgcagcgactac

SEQ ID NO: 40003 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcatcctaacgggcctctgggtcatcgcccacgaatgcggccaccacgccttcagcgactac

SEQ ID NO: 40004 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40005 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgccccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggtcaccacgccttcagcgactac

SEQ ID NO: 40006 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40007 - DNA, 317 bp, Artificial
  Mutation in BnaC.FAD2.b introduced by TALE nuclease pair BnFAD2_T03
caggatccatgggtgcaggtgcaagaatgcaagtctctcctccctccagctcccccgaaaccaaaaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40008 - DNA, 357 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtccgatctagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40009 - DNA, 370 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccgtccagcggctgttgccggtgttgtgcctggcggagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 40010 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagccaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 40011 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgcctgcagcgactac

SEQ ID NO: 40012 - DNA, 348 bp, Artificial
  Mutation in BnaC.FAD2.b introduced by TALE nuclease pair BnFAD2_T03
caggatccatgggtgcagggggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcttcccccaccctctcccttacctcgcctggcccctctactgggccggccagggctgcgtcctaacgggcctctgggtcatcgcccacgaatgcggccaccacgccttcagcgactac

SEQ ID NO: 40013 - DNA, 338 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40014 - DNA, 411 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctcgccggcaataatggtggcaagcaggcgctggagacggtccagcggctgttgccggtgctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 40015 - DNA, 350 bp, Artificial
  Mutation in BnaC.FAD2.b introduced by TALE nuclease pair BnFAD2_T03
caggatccatgggtgcaggtgcaagaatgcatgtttctcctcactccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgcctgcagcgactac

SEQ ID NO: 40016 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40017 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcacacgagtgcggccaccacgccttcagcgactac

SEQ ID NO: 40018 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaacgggcctctgggtcatcgcccacgaatgcggccaccacgccttcagcgactac

SEQ ID NO: 40019 - DNA, 333 bp, Artificial
  Mutation in BnaC.FAD2.b introduced by TALE nuclease pair BnFAD2_T03
caggatccatgggtgcaggtggaagaatgcaagtttctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagggcggccaccacgccttcagcgactac

SEQ ID NO: 40020 - DNA, 373 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccaccattcactctgcgttatcccctgattctgtggataaccgtattaccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40021 - DNA, 336 bp, Artificial
  Mutation in BnaC.FAD2.b introduced by TALE nuclease pair BnFAD2_T03
caggatccatgggtgcagggggaagaatgcaagtttctccttacttaagctcccccggaacgaacaccatcaaacgcgtcccctgcgagacaccaccattcactcttgacatcaagaaagcaatcccacctcactgcttcaaacgctccctcccacgctccttctcctcttcgacaccatcatctcctcctcggcccctccctctaccacctctccacagcctacttccctctcccttacctcgcctgacccctctactgagcctgccaaggctgcgtccgaacgggcctctgggtcatagcccacgagtgcggccaccacgccatcagcgactac

SEQ ID NO: 40022 - DNA, 418 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctctccagcggctgttgccggtgctgtgccaggcccacggcttgaccccccagcaggtggtggccatcgccagcaataatggggagacctcaagaaagcaatcccacctcactgcttcaaacgctccatcccacgctccttctcctcttcgacaccatcacctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40023 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgcctgcagcgactac

SEQ ID NO: 40024 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 40025 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 40026 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggacctcaagaaagcaatcccaccgcactgtttcaaacgctcgatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40027 - DNA, 392 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctctccagcgcctgcttgccaccattattgctggcgatggccaccacctgctggggggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 40028 - DNA, 347 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40029 - DNA, 335 bp, Artificial
  Mutation in BnaC.FAD2.b introduced by TALE nuclease pair BnFAD2_T03
caggatccatgggtgcaggtggaagaatgcaagtctctcctccctccagctccccaggaaccaacaccatcaagcgcgtaccctgcgagacaccgcccttcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40030 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgtgcctctgggtcatcgcccacgaatgcggccaccacgccttcagcgactac

SEQ ID NO: 40031 - DNA, 431 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggcaggtggtggccatcgccagcaatggcggtggcaagcaggcgctggagacggtccagcggctgttgccggtgctgggccaggcccacggctagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40032 - DNA, 403 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtcccctgcgagacaccacccttcactctagatcggcgatatcgatgctgtccatgtgctgtctctcgaacttggcagcggcagtctccttatcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40033 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40034 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcgactcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40035 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40036 - DNA, 400 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctggcaacgctgcgatcatgtcctgatacttgacagcgacggtccctatcgcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgctttcagcgactac

SEQ ID NO: 40037 - DNA, 349 bp, Artificial
  Mutation in BnaC.FAD2.b introduced by TALE nuclease pair BnFAD2_T03
caggatccatgggtgcaggcgcaagaatgcaagtgtctcctcactcccgctcccccggaaccaacaccctcaaacgcgtcccctgcgagacaccacccttcactagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40038 - DNA, 276 bp, Artificial
  Mutation in BnaC.FAD2.b introduced by TALE nuclease pair BnFAD2_T03
caggatccatgggtgcaggtggaagaatgcaagtctctcctctcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 40039 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagactccgcccttcactgtcgaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40040 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaaactcaagaaagcaatcccaccgcactgtttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 40041 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaagactgcgtcctaacgggcctctgggtcatcgcccacgaatgcggccaccacgccttcagcgactac

SEQ ID NO: 40042 - DNA, 432 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccaccattcacggcgatggccaccacctgctccggggtcaagccgtgggcctggcacactccgggccgttgcttcacaacgttcaaatccgctcccggcggatttgtcctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40043 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40044 - DNA, 435 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcatcctcacctcctccagggtcagggtgccggcctttggtggcaagcaggcgctggagacggtccagcggctgttgccggtgcggagaactcaagaaagcaatcccacctcactgcttcaaacgctccatccctcgctccttctcctacctcctcttcgacatcctcgtctcctcctccctctaccccctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 40045 - DNA, 330 bp, Artificial
  Mutation in BnaC.FAD2.b introduced by TALE nuclease pair BnFAD2_T03
caggatccatgggtgcaggtggcagaatgcaagtctctcctccctccagctccccggaaccaacaccctcaaacgcgtcccctgcgagacctcaagaaagcaatcccacctaactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40046 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactatcccacctcactgcttcaaacgctccctccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40047 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgatacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40048 - DNA, 396 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggttcagcctggtcagctgggccttgtagttgcccttgaagtggccggacacgaacaggagaactcaagaaagcaatcccacctcactgcttcaaacgctccatcccacgctccttctcctcttcgacatcatcatctcctcctcggctcctccctctcccacctctccccagcctacttccctctcccttacctcgcctgacccctctactgggcctgccaaggctgcgtcctaacgggcctctgggtcatagcccacgagtgcggccaccacgccttcagcgactac

SEQ ID NO: 40049 - DNA, 329 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40050 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccacctcactgcttcaaacgctccatcccacgctccttctcctcttcgacatcatcatctcctcctccctctaccacctctccacagcctacttccctctcctccctcacactctctcctacttcgcctggcctctctactgggcctgccaaggctgcgtcctaacgggcctctgggtcatagcccacgagtgcggccaccacgccttcagcgactac

SEQ ID NO: 40051 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctccctttcctcgcctggcccctctactgggcctgccaaggctgcgtcctaacgggcctctgggtcatcgcccacgaatgcggccaccacgccatcagcgactac

SEQ ID NO: 40052 - DNA, 348 bp, Artificial
  Mutation in BnaC.FAD2.b introduced by TALE nuclease pair BnFAD2_T03
caggatccatgggcaggtggaagaatgcaagtctctcctccctccagctcccccgaaaccaaaaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40053 - DNA, 328 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccacccttcactcaagaaaacaatccgacctcactgcttcaaacgctccatcccacgctccttctcctcttcgacatcatcatcacctcctcagctcctccctctaccacctctccacagcctacttccctctcccttacctcgcctggcccctctactgggcctgccagggctgcgtcctaaccggcctctgggtcatagcccacgagtgcggccaccacgccttcagcgactac

SEQ ID NO: 40054 - DNA, 389 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttggcggcggcaggccggcgctggagcgccttgttgcccagttatctcgccctgatccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40055 - DNA, 335 bp, Artificial
  Mutation in BnaC.FAD2.b introduced by TALE nuclease pair BnFAD2_T03
caggatccatgggtgcaggtgccagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40056 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctcccccttaccccgcctggcccctccactgggccggccatggctgcgtcctaacgggcctctgggtcatagcccacgagtgcggccaccacgccttcagcgactac

SEQ ID NO: 40057 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40058 - DNA, 300 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaagcaagcaatcccgcctcactgcttcaaacgctccatccctcgctccttctcctacctcctcttcgacatcctcgtctcctcctccctctaccacctctccacagcctacttccctctcctcccccaccctctcccttacctcgcctgaccactctactgggcctgccaaggctgcgtcctaacgggcctctgggtcatagcccacgagtgcggccaccacgccttcagcgactac

SEQ ID NO: 40059 - DNA, 319 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40060 - DNA, 349 bp, Artificial
  Mutation in BnaC.FAD2.b introduced by TALE nuclease pair BnFAD2_T03
caggatccatgggtgcaggtgcaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 40061 - DNA, 337 bp, Artificial
  Mutation in BnaC.FAD2.b introduced by TALE nuclease pair BnFAD2_T03
caggatccatgggtgcaggtgcaagaatgcaagtgtctactcactccaagaagtctgaaaccgacaacatcaagcgcgtcccctgcgagacaccaccattcacctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40062 - DNA, 360 bp, Artificial
  Mutation in BnaC.FAD2.b introduced by TALE nuclease pair BnFAD2_T03
caggatccatgggtgcaggtggaagaatgcaagtgtctcctccctcccgctcccccggaaccaacaccctcaaacgcgtcccctgcgagacaccaccattcactccatcccacgctccttctcaagaaagccatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40063 - DNA, 275 bp, Artificial
  Mutation in BnaC.FAD2.b introduced by TALE nuclease pair BnFAD2_T03
caggatccatgggtgcaggtggaagaatgcaagtctctagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40064 - DNA, 293 bp, Artificial
  Mutation in BnaC.FAD2.b introduced by TALE nuclease pair BnFAD2_T03
caggatccatgggtgcaggtggaagaatgcaagtctctcctccctccagctcccccggaaccaagacctcaagaaagcaatcccacctcactgcttcaaacactccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40065 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 40066 - DNA, 338 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40067 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagttgccggtgctgtgccaggcccacggcttgaccccccagcaggtggtggccatcgccagcagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40068 - DNA, 278 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacatcctcgtctcctcctccctctaccacctctccacagcctacttccctctcctcccccaccctctcccttccctcgcctggcccctctaccgggcctgccaaggctgcgtcctaacgtgcctctgggtcatcgcccacgaatgcggccaccacgccttcagcgactac

SEQ ID NO: 40069 - DNA, 333 bp, Artificial
  Mutation in BnaC.FAD2.b introduced by TALE nuclease pair BnFAD2_T03
caggatccattggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40070 - DNA, 315 bp, Artificial
  Mutation in BnaC.FAD2.b introduced by TALE nuclease pair BnFAD2_T03
caggatccatgggtgcaggtggaagaatgcaagtctctcctccctcccgctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcagcgactac

SEQ ID NO: 40071 - DNA, 326 bp, Artificial
  Mutation in BnaC.FAD2.b introduced by TALE nuclease pair BnFAD2_T03
caggatccatgggtgcaggtggcagaatgcaagtctctactcactccagctcccccggaaccaacaccctcaaacgcgtcccctagcaggcgctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaacgggcctctgggtcatcgcccacgaatgcggccaccacgccttcagcgactac

SEQ ID NO: 40072 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactcc

SEQ ID NO: 40073 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcactgaactcaagaaagcaatcccacctcactgcttcaaacgctccatcccacgctccttctcctcttcgacatcatcatctcctcctcggctcctccctctaccacctctccacagcctatttccctctcccttacctcgcctgacccctctactgggcctgccaaggctgcgtcctaacgggcctctgggtcatagcccacgagtgcggccaccacgccttcagcgactac

SEQ ID NO: 40074 - DNA, 335 bp, Artificial
  Mutation in BnaC.FAD2.b introduced by TALE nuclease pair BnFAD2_T03
caggatccatgggtgcaggtggaataatgcaagtgcctcctccctccaaaaagactgaaaccgacaacatcaagcgcgtaccctgcgagacaccgcccttcactgggaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 40075 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccctgacctcaagaaagcaatcccacctcactgcttcaaacgctccatccctcgctccttttcctacctcctcttcgacatcctcgtctcctcctccctctaccacctctccacagcctaattccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40076 - DNA, 335 bp, Artificial
  Mutation in BnaC.FAD2.b introduced by TALE nuclease pair BnFAD2_T03
caggatccatgggtgcaggtggaagaatgcaagtgtctcctccctcccagaagtctgaaaccgacaccatcaagcgcgtaccctgcgagacaccaccattcacttagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40077 - DNA, 300 bp, Artificial
  Mutation in BnaC.FAD2.b introduced by TALE nuclease pair BnFAD2_T03
caggatccatgggtgcaggtggaagaatgcaagtctctcctccctcccgctcccccgaaaccaaagaaagcaatcccccctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40078 - DNA, 333 bp, Artificial
  Mutation in BnaC.FAD2.b introduced by TALE nuclease pair BnFAD2_T03
caggatccatgggtgcaggtggcagaatgcaagtctctactccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40079 - DNA, 349 bp, Artificial
  Mutation in BnaC.FAD2.b introduced by TALE nuclease pair BnFAD2_T03
caggatccatgggtgcaggtggcagaatgcaagtatctcctccctccagctcccacggaaccaacaccctcaaacgcgtcccctgcgagacaccaccattcactcgacctcaagaaagcaatcccacctcactgcttcaaacgctccatcccacgctccttctcctcttcgacatcatcatcccctcctcggctcctccctctaccacctctccacagcctacttccctctcctcccccaccctctcccttacctcgcctggcccctctactgggcctgccaaggctgcgtactaacgggcctctgggtcatcgcccacgaatgcggccaccacgccttcagcgactac

SEQ ID NO: 40080 - DNA, 400 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctggcaacgctgcgatcatgtcctgatacttgacagcgacggtccctatcgcagacctcaagaaagcaatcccacctcactgcttcaaacgctccatccctcgctccttctcctacctcctcttcgacatcctcgtctcctcctccccctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40081 - DNA, 350 bp, Artificial
  Mutation in BnaC.FAD2.b introduced by TALE nuclease pair BnFAD2_T03
caggatccatgggtgcaggtggaagaatgcaagtgtctactccatcccaaaagcctgaaaccgacaacatcaagcgcgtaccctgcgagacaccgcccttcactgtagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgtgtcatcgcccacgaatgcgtcctccacgccttcagcgactac

SEQ ID NO: 40082 - DNA, 351 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccacccttcactctagaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40083 - DNA, 350 bp, Artificial
  Mutation in BnaC.FAD2.b introduced by TALE nuclease pair BnFAD2_T03
caggatccatgggtgcaggtgcaagaatgcaagtgtcccctccctccagctcccccgaaaccaaaaccctcaaacgcgtcccctgcgagacaccacccttcactccagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgcctgggctgcgtcctaaccggcgtctgggtcatatcccacgagtgcggcctccacgccatcagcgactac

SEQ ID NO: 40084 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctttagcaatcccacctcactgcttcaaacgctccatcccacgctccttctcctcttcgacatcatcatctcctcctcggctcctccctctaccacctctccaaagcctacttccctctcccttacctcgcctgacccctctactgggcctgccaaggctgcgtcctaacgggcctctgggtcatagcccacgagtgcggccaccacgccttcagcgactac

SEQ ID NO: 40085 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40086 - DNA, 331 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgatacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40087 - DNA, 337 bp, Artificial
  Mutation in BnaC.FAD2.b introduced by TALE nuclease pair BnFAD2_T03
caggatccatgggtgcaggaggtagaatgcaagtttctcctccctcccgctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgtggccaccacgccttcagcgactac

SEQ ID NO: 40088 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccatagcctacttccctctcctcccccaccctctcccttacctcgcctggcccctctactgggccttccaaggctgcgtcctaacgggcctctgggtcatcgcccacgaatgcggccaccacgccttcagcgactac

SEQ ID NO: 40089 - DNA, 323 bp, Artificial
  Mutation in BnaC.FAD2.b introduced by TALE nuclease pair BnFAD2_T03
caggatccatgggtgcaggtggaagaatgcaagtctctcctccaccaacaccctcaaacgcgtcccctgcgagacaccaccattcactctcgggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40090 - DNA, 335 bp, Artificial
  Mutation in BnaC.FAD2.b introduced by TALE nuclease pair BnFAD2_T03
caggatccatgggtgcaggtggaagaatgcaagtttctcctcccttcagctcccccggaaccaacaccctcaaacgcgtcccctgcgagacaccaccattcactcagaccacaagaaagcaatcccacctcactgcttcaaacgctccatcccacgctccttctcctcttcgacatcatcatctcctcctcggctcctccctctaccacctctccccagcctacttccctctcccttacctcgcctgacccctctactgggcctgccagggctgcggcctaaccggcgtctgggtcatagcccacgagtgcggccaccacgccatcagcgactac

SEQ ID NO: 40091 - DNA, 279 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcttcgacatcctcgtctcctcctccctctaccacctctccacagcctacttccctctcctcccccaccctctcccttacctcgcctggcccctctactgggcctaccaaggctgcgtcctaacgggcctctgggtcatcgcccacgaatgcggccaccacgccttcagcgactac

SEQ ID NO: 40092 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40093 - DNA, 351 bp, Artificial
  Mutation in BnaC.FAD2.b introduced by TALE nuclease pair BnFAD2_T03
caggatccatgggtgcaggtggaagaatgcaagtctctcctccctccagctccaccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40094 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccaccctccttctcctcttcgacatcatcatctcctcctccctctcccacctctccacagcctacttccctctcctcccccaccctcccccttacctcgcctggcccctctactgggcctgccaaggctgcgtcctaacgggcctctgggtcatcgcccacgaatgcggccaccacgccttcagcgactac

SEQ ID NO: 40095 - DNA, 386 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcttccaggcccacggcttgaccccccagcaggtggtggccatcgccagcaatggacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40096 - DNA, 283 bp, Artificial
  Mutation in BnaC.FAD2.b introduced by TALE nuclease pair BnFAD2_T03
caggatccatgggtgcaggtggaagaatgcaagtgtctcctccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40097 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgccccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40098 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaatgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcctctgggtcatagcccacgagtgcggccaccacgccttcagcgactac

SEQ ID NO: 40099 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 40100 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtagaactcaacaaagcaatcccaccgcactgttgcaaacgctccatcccacgcccctcctcctcttcgccatcatcatctcctcctcggcgcctccctctaccacctctccacagcctcctaccctctcccttacctcgcctgacccctctactgggcctgccaaggctgcgtcctaacgggcctctgggtcatagcccacgagtgcggccaccacgccttcagcgactac

SEQ ID NO: 40101 - DNA, 331 bp, Artificial
  Mutation in BnaC.FAD2.b introduced by TALE nuclease pair BnFAD2_T03
caggatccatgggtgcaggtggaagaatgcaagtgtctactccctccaaaaagtctgaaaccgacaccatcaagcgcgtaccctgcgagacaccgcccatcagaactcaagaaagcaatcccaccgcactgtttcaaacgctccaacccacgctccttctcctcttcgacatcatcatctcctcctcggctcctccctctaccacctctccacagcctacttccctctcccttacctcgcctgacccctctactgggcctgccaaggctgcggcttaacgggcctcggggtcatagcccacgagtgcggccaccacgccttcagcgactac

SEQ ID NO: 40102 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40103 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40104 - DNA, 344 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgacgggagaactcaagaaagcaatcccaccgcactgtttcaaacgctcgatccctcgctccttctcctacctcctcttcgacatcctcgtctccacctccctctaccacctctccacagcctacttccctctcctcccccaccctctcccttgcctcgcctggcccctctactgggcctgccaaggctgcgtcttaacgggcctctgggtcatcgcccacgaatgcggccaccacgccttcagcgactac

SEQ ID NO: 40105 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccacggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40106 - DNA, 295 bp, Artificial
  Mutation in BnaC.FAD2.b introduced by TALE nuclease pair BnFAD2_T03
caggatccatgggtgcaggtggaagaatgcaagtctctcatccccccaggtagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40107 - DNA, 384 bp, Artificial
  Mutation in BnaC.FAD2.b introduced by TALE nuclease pair BnFAD2_T03
caggatccatgggtgcaggtgaaagaatgcaagtctctcctccctccggctccaccgaacccaaaaccctcaaacgcgtcccctgcgagacaccacccttccccggagcaggtggtggccatcgccagcaatattggtggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggcggcgtcctaacgggcctctgggtcatcgcccacgaatgcggccaccacgccttcagcgactac

SEQ ID NO: 40108 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccaagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaacgggcctctgggtcatcgcccacgaatgcggccaccacgccttcagcgactac

SEQ ID NO: 40109 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgtagagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 40110 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtcgcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40111 - DNA, 317 bp, Artificial
  Mutation in BnaC.FAD2.b introduced by TALE nuclease pair BnFAD2_T03
caggatccatgggtgcaggtgggagaatgcaagtctcacctccctccagctcccccgaaaccaaaaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 40112 - DNA, 403 bp, Artificial
  Mutation in BnaC.FAD2.b introduced by TALE nuclease pair BnFAD2_T03
caggatccatgggtgcaggtggaagaatgcaagtgtctcctccctccaaaaagcctgaaaccgacaacatcaagcgcgtgccctgcgagacaccgcccttcactgttgtccggccacttcaagggaaactacaaggcccagctgaccaggctgaaccacatcaccaactgcggagaactcaagaaagcaatcccacctcactgcttcaaacgctccatcccacgctccttctcctcttcgacatcatcatctcctcctcggctcctccctctcccacctccccccagcctacttccctctcccttacctcgcctgacccctctactgggcctgccaaggctgcgtcctaacgggcctctgggtcatagcccacgagtgcggccaccacgccttcagcgactac

SEQ ID NO: 40113 - DNA, 337 bp, Artificial
  Mutation in BnaC.FAD2.b introduced by TALE nuclease pair BnFAD2_T03
caggatccatgggtgcaggtggaagaatgcaagtgtctcctcactccaagaagtctgaaaccgacaccatcaagcgcgtaccctgcgagacaccgcccttcgaactcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40114 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaacgggcctctgggtcatcgcccacgaatgcggccaccacgccttcagcgactac

SEQ ID NO: 40115 - DNA, 283 bp, Artificial
  Mutation in BnaC.FAD2.b introduced by TALE nuclease pair BnFAD2_T03
caggatccatgggtgcaggtggaagaatgcaagtgtctcctccatcaagaaagcaatcccacctcactgcttcaaacgctccatccctcgctccttctcctacctcctcttcgacatcctcgtctcctcctccctctaccacctctccacagcctacttccctctcctcccccaccctctcccttaccccgcctagcccctctactgggcctgccaaggcagcggcctaacgggcctctgggtcatcgcccacaaatgcggccaccacgccttcagcgactac

SEQ ID NO: 40116 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40117 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40118 - DNA, 347 bp, Artificial
  Mutation in BnaC.FAD2.b introduced by TALE nuclease pair BnFAD2_T03
caggatccatgggtgcaggtggaagaatgcaagtctcccctccctccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 40119 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40120 - DNA, 342 bp, Artificial
  Mutation in BnaC.FAD2.b introduced by TALE nuclease pair BnFAD2_T03
caggatccatgggtgcaggtggaagaatgcaagtctctcctccctccagctccaccggaaccaacaccctcaaacgcgtcccctgcgagacaccaccattcactcggacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40121 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40122 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttacctcaagaaagcaatcccacctcactgcttcaaacgctccatccctcgctccttctcctacctcctcttcgacatcctcgtctcctcctccctctaccacctctccacagcctacttcccctcctcccccaccctctcccttacctcgcctggcccctctactgggcctgccaaggctgcgtcctaacgggcctctgggtcatcgcccacgaatgcggccaccacgccttcagcgactac

SEQ ID NO: 40123 - DNA, 341 bp, Artificial
  Mutation in BnaC.FAD2.b introduced by TALE nuclease pair BnFAD2_T03
caggatccatgggtgcaggtggaagaatgcaagtgtctcctcactccaagaagtctgaaaccgacaacatcaagcgcgtaccctgcgagacaccgcccgaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40124 - DNA, 359 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggtcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 40125 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggcggcgtcctaacgggcctctgggtcatcgcccacgaatgcggccaccacgccttcagcgactac

SEQ ID NO: 40126 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagtcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcggcctaacgggcctctgggtcatcgcccacgaatgcggccaccacgccttcagcgactac

SEQ ID NO: 40127 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccacctcactgcttcaaacgctccatccctcgctccttctcctacctcctcttcgacatcctcgtctcctcctccctctaccacctctccacatcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40128 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 40129 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagactgcgtcctaacgggcctctgggtcatagcccacgagtgcggccaccacgccttcagcgactac

SEQ ID NO: 40130 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40131 - DNA, 335 bp, Artificial
  Mutation in BnaC.FAD2.b introduced by TALE nuclease pair BnFAD2_T03
caggatccatgggtgcaggtggaagaatgcaagtctctcctcccgccagctcccccggaaccaacaccctcaaacgcgtcccctgcgagacaccaccattcacttagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40132 - DNA, 349 bp, Artificial
  Mutation in BnaC.FAD2.b introduced by TALE nuclease pair BnFAD2_T03
caggatccatgggtgcaggtggcagaatgcaagtctctactccctccagctcccccgaaaccaaaaccctcaaacgcgtcccctgcgagccaccacccttcacggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcggcctaacgggcctctgggtcatagcccacgagtgcggccaccacgccttcagcgactac

SEQ ID NO: 40133 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttaccgcgcctgacccctctactgggcctgccaaggctgcgtcctaacgggcctctgggtcatagcccacgagtgcggccaccacgccttcagcgactac

SEQ ID NO: 40134 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctacaacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40135 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgtgtcctaacgggcctctgggtcatcgcccacgaatgcggccaccacgccttcagcgactac

SEQ ID NO: 40136 - DNA, 336 bp, Artificial
  Mutation in BnaC.FAD2.b introduced by TALE nuclease pair BnFAD2_T03
caggatccatgggtgcaggtggaagaatgcaagtctctcctacctccagctccaccggaaccaacaccctcaaacgcgtcccctgcgagacaccaccattcactcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40137 - DNA, 331 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40138 - DNA, 337 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40139 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgtttcaaacgctccatcccacgctccttctcctcttcgacatcatcatctcctcctcggctcctccctctaccacctctccacagcctacttccctctcccttacctcgcctgacccctctactgggtctgccaaggctgcgtcctaacgggcctctgggtcatagcccacgagtgcggccaccacgccttcagcgactac

SEQ ID NO: 40140 - DNA, 330 bp, Artificial
  Mutation in BnaC.FAD2.b introduced by TALE nuclease pair BnFAD2_T03
caggatccatgggtgcaggtgaaagaatgcaagtctctcctccctccagctcccccggaaccaacaccctcaaacgcgtcccctgcgagacaccaccattcaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40141 - DNA, 336 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccacccttcactctgagacctcaagaaagcaatcccacctcactgcttcaaacactccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40142 - DNA, 331 bp, Artificial
  Mutation in BnaC.FAD2.b introduced by TALE nuclease pair BnFAD2_T03
caggatccatgggtgcaggtggaagaatgcaagtctctcctcccaccagctcccccgaaaccaaaaccctcaaacgcgtcccctctgagacctcaagaaagcaatcccacctcactgcttcaaacgctccatccctcgctccttctcctccctcctcttcgacatcctcgtctcctcctccctctaccacctctccacagcctacttccctctcctcccccaccctctcccttacctcgcctggcccctctactgggcctgccaaggcggcgtcctaacgggcctctgggtcatcgcccacgaatgcggccaccacgccttcagcgactac

SEQ ID NO: 40143 - DNA, 403 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgctggcgatggccaccacctgctggggggtcaagccgtgggcctggcacagcaccggcaacagccgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40144 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtaccctgcgagacaccacccttcactgtttcaaacgctcgatccctcgctctttcttctacctcatctgggacatcatcatagcctcctgcttctactacgtcgccaccacttacttccctctcctcccccaccctctcccttacctcgcctggcccctctactgggcctgccaaggctgcgtcctaacgggcctcggggtcatcgcccacgaatgcggccaccacgccttcagcgactac

SEQ ID NO: 40145 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgctgccaccacgccttcagcgactac

SEQ ID NO: 40146 - DNA, 325 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40147 - DNA, 342 bp, Artificial
  Mutation in BnaC.FAD2.b introduced by TALE nuclease pair BnFAD2_T03
caggatccatgggtgcaggtggaagaatgcaagtgtctcctcactccaagaagtctgaaaccgacaccatcaagcgcgtaccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40148 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcgagacctcaagaaagcaatcccacctcactgcttcaaacgctccatccctcgctccttctcctacctcctcttcgacatcctcgtcgcctcctccctctaccacctctccacagcctacttccctctcctaccccaccctctcccttacctcgcctggcccctctactgggcctgccaaggctgcgtcctaacgggcctctgggtcatcgcccacgagtgcggccaccacgccttcagcgactac

SEQ ID NO: 40149 - DNA, 335 bp, Artificial
  Mutation in BnaC.FAD2.b introduced by TALE nuclease pair BnFAD2_T03
caggatccatgggtgcaggtggaagaatgcaagtttctcctcccttcagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactggtccgcccaaggctgcgccctaacgggcttctgggtcatagcccacgagggcggccaccacgcctgcagcgactac

SEQ ID NO: 40150 - DNA, 374 bp, Artificial
  Mutation in BnaC.FAD2.b introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgttttgccagcgcctaatgcgccgggagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcgtcgcccacgaatgcggccaccacgccttcagcgactac

SEQ ID NO: 40151 - DNA, 337 bp, Artificial
  Mutation in BnaC.FAD2.b introduced by TALE nuclease pair BnFAD2_T03
caggatccatgggtgcaggtggaagaatgcaagtctctcctccctccggctcccccggaaccaacaccctcaaacgcgtcccctgcgagacaccaccattcactctaagacctcaagaaagcaatcccacctcactgcttcaaacgctccatcccacgctccttctcctcttcgacatcatcatctcctcctcgtctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40152 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40153 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaccgctccaccccacgctccttctcctcttcgacaccatcatctcctcctcggctcctccctctaccacctctccccagcctacttccctctcccttacctcgcctgacccctctactgggcctgccaaggctgcgtcctaacgggcctctgggtcatagcccacgagtgcggccaccacgccttcagcgactac

SEQ ID NO: 40154 - DNA, 334 bp, Artificial
  Mutation in BnaC.FAD2.b introduced by TALE nuclease pair BnFAD2_T03
caggatccatgggtgcaggtggcagaatgcaagtctctactccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40155 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccccagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40156 - DNA, 370 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccgtccagcggctgttgccggtgttgtgcctggcggagacctcaagaaagcaatcccacctcactgcttcaaacgctccatcccacgctccttctcctcttcgacatcatcatctcctcctcggctcctccctctaccacctctccccagcctccttccctctcccttacctcgcctgacccctctactgggcctgccaatgctgcgtcctaacgggcctctgggtcatagcccacgagtgcggccaccacgccttcagcgactac

SEQ ID NO: 40157 - DNA, 324 bp, Artificial
  Mutation in BnaC.FAD2.b introduced by TALE nuclease pair BnFAD2_T03
caggatccatgggtgcaggtggcagaatgcaagtgtctcctccctccaaaaagcctgaaaccgacaacatcaagcgcgtaccctgcgagacaccgcccttcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40158 - DNA, 327 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagatagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccagggctgcgtcctaacgggcctctgggtcatcgcccacgaatgcggccaccacgccttcagcgactac

SEQ ID NO: 40159 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggagacctcaagaaagcaatcccacctcactgcttcaaacgctccatcccacgctccttctcctcttcgacatcatcatctcctcctccctctaccacctctcccagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40160 - DNA, 334 bp, Artificial
  Mutation in BnaC.FAD2.b introduced by TALE nuclease pair BnFAD2_T03
caggatccatgggtgtaggtggaagaatgcaagtctctcctccctccagctcccccggaaccaacaccctcaaacgcgtcccctgcgagacaccaccattcacttgacctcaagaaagcaatcccacctcactgcttcaaacgctccatcccacgctccttctcctcttcgacatcatcatctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 40161 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgccagaccccacccaaccaatcccacctcactgcttcaaacgccccatcccaccctccttctcctctccgccatcatcatctcctcctcctctcctccccctcccacctctccacctcctacttccctctcccttacctcgcctggcccctctactgggcctgccaaggctgcgtcctaacgggcctctgggtcatagcccacgagtgcggccaccacgccttcagcgactac

SEQ ID NO: 40162 - DNA, 335 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40163 - DNA, 321 bp, Artificial
  Mutation in BnaC.FAD2.b introduced by TALE nuclease pair BnFAD2_T03
caggatccatgggtgcaggtgcaagaatgcaagtctctcctgcctccagctcccccggaaccaacaccctcaaacgcgtcccctgccagacaccaccataaaaagcaatcccacctcactgcttcaaacgctccatcccacgctccttctcctctccgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagctactac

SEQ ID NO: 40164 - DNA, 336 bp, Artificial
  Mutation in BnaC.FAD2.b introduced by TALE nuclease pair BnFAD2_T03
caggatccatgggtgcaggtggaagaatgcaagtgtctcctcactccagctcccccggaaccaacaccctcaaacgcgtcccctgcgagacaccacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttctgcgactac

SEQ ID NO: 40165 - DNA, 349 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccacccttcactcagacctcaagaaagcaatcccaccgcactgtttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 40166 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccggagacctcgagaaagcaatcccacctcactgcttcaaacgctccatcccacgctccttctcctcttcgacatcatcatctcctcctcggctcctccctctaccacctctccacagcctccttccctctcccttacctcgcctggcccctctactgggcctgccaaggctgcgtcctaactggcctctgggtcatagcccacgagtgcggccaccacgccttcagcgactac

SEQ ID NO: 40167 - DNA, 350 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactcaggacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtcggggtcatagcccacgagtgcggccaccacgccttcagcgactac

SEQ ID NO: 40168 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagtaatcccaccgcactgtttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 40169 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggcggcgtcctaacgggcctctgggtcatcgcccacgaatgcggccaccactccttcagcgactac

SEQ ID NO: 40170 - DNA, 420 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtgttgtgccaggcccacggcttgaccccggagcaggtggtggccatcgccagccacgatggcggcaacagccgctggacccagacctcaagaaagcaatcccacctcactgcttcaaacgccccatcccacgctccttctcctctccgacatcatcaccccctcctcggctcctccctctcccacctccccacagcctacttccctctcccttgcctcgcctgaccccgctactgggcctgccaagcctgcgtcctaacgggcctctgggtcatagcccacgagtgcggccaccacgccttcagcgactac

SEQ ID NO: 40171 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctacgaaacaccacccttcactcacctcaagaaagcaatcccacctcactgcttcaaacgctccatccctcgctccttctcctccctcctcttcgacatcctcgtctcctcctcccgctaccacctatccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 40172 - DNA, 333 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40173 - DNA, 381 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggagagcgttcaccgacaaacaacagataaaacgaaaggcccagtcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40174 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcctcccccgccctctcccttacctcgcctggcccctctactgggcctgccagggctgcgtcctaaccggcgtctgggtcatcgcccacgaatgcggccaccacgccttcagcgaactac

SEQ ID NO: 40175 - DNA, 390 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctccagcgcctgcttgccaccattattgctggcgatggccaccacctgctggggggtcaagttgagcggggcacccgtcagtgcattgcgccagagacctcaagaaagcaatcccacctcactgcttcaaacgctccatccctcgctccttctcatacctcctcttcgacatcctcgtctcctcctccctctaccacctctccacagcctacttccctctcccttaccacgcctgacccctctactgggcctgccaaggctgcgtcctaacgggcctctgggtcatagcccacgagtgcggccaccacgccttcagcgacac

SEQ ID NO: 40176 - DNA, 335 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40177 - DNA, 426 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggggagaaaggcggacaggtatccggtaagcggcagggtcggaacagccgctggaccgtctccagcgcctgcttgccaccattattgctggccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40178 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgacctcaagaaagcaatcccacctcactgcttcaaacgctccatcccacgctccttctcctcttcgacatcatcatctcctcctcggctcctccctctaccacctctccacagcctacttccctctcccttacctcccctgacccctctactgggcctgccaaggctgcgtcctaacgggcctctgggtcatagcccacgagtgcggccaccacgccttcagcgactac

SEQ ID NO: 40179 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccatcggagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggcaaccacgccttcagcgactac

SEQ ID NO: 40180 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccaccctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 40181 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40182 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccagggctgcgtcctaacgggcctctgggtcatagcccacgagtgcggccaccacgccttcagcgactac

SEQ ID NO: 40183 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccacctcactgcttcaaacgctccatcccacgctccttctcctcttcgacatcatcatctcctcctcggctcctccctctaccacctctccacagcctacttccctctcctcccccaccctctcccttccctcgcctggcccctctactgggcctgccaaggctgcgtcctaacgggcctcggggtcatcgcccacgaatgcggccaccacgccttcagcgactac

SEQ ID NO: 40184 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagcctgaaaccgacaacatcaagcgcgtaccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40185 - DNA, 335 bp, Artificial
  Mutation in BnaC.FAD2.b introduced by TALE nuclease pair BnFAD2_T03
caggatccatgggtgcaggtggaagaatgcaagtctctcctccctcccgctcccccggaaccaacaccctcaaacgcgtcccctgcgagacaccaccattcactcgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggccggccaaggctgcgtcctaacgggcctctgggtcatagcccacgagtgcggccaccacgccttcagcgactac

SEQ ID NO: 40186 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgtgtcctaacgggcctctgggtcatagcccacgagtgcggccaccacgccttcagcgactac

SEQ ID NO: 40187 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactcgagacctcaagaaagcaatcccacctcactgcttcaaacgctccatcccacgttccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40188 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcatgacctcaagaaagcaatcccacctcactgcttcaaacgctccatcccacgctccttctcctcttcgacatcatcatctcctcctcggctcctccctctaccacctctccacagcctacttccctctcccttacctcgcctgacacctctactgggcctgccaaggctgcgtcctaacgggcctctgggtcatcgcccacgaatgcggccaccacgccttcagcgactac

SEQ ID NO: 40189 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgacctcaagaaagcaatcccacctcactgcttcaaacttctcctcttcgacatcatcatctcctcctcggctcctccctctaccacctctccacagcctacttccctctcccttacctcgcctgacccctctactgggcctgccaaggctgcgtcctaacgggcctctgtgtcatagcccacgagtgcggccaccacgccttcagcgactac

SEQ ID NO: 40190 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40191 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 40192 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 40193 - DNA, 313 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctcaccctctctcctacttcgcctggcctctctactgggcctgccagggctgcgtcctaaccggcgtctgggtcatagcccacgagtgcggccaccacgccttcagcgactac

SEQ ID NO: 40194 - DNA, 334 bp, Artificial
  Mutation in BnaC.FAD2.b introduced by TALE nuclease pair BnFAD2_T03
caggatccatgggtgcagttggaagaatgcaagtctctcctccctccagctcccccggaaccaacaccctcaaacgcgtcacctgcgagacaccaccattcactcgacctcaagaaagcaatcccacctcactgcttcaaacgctccatcccacgcgccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 40195 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccaccattcactcagacctcaagaaagcaatccaacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40196 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctagacctcaagaaagtaatcccacctcactgcttcaaacgctccatcccaccctccttctcctcttcgacattatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40197 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatcgcccacgaatgctgccaccacgccttcagcgactac

SEQ ID NO: 40198 - DNA, 279 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaacgggcctctgggtcatcgcccacgaatgcggccaccacgccttcagcgactac

SEQ ID NO: 40199 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccacctcactgcttcaaacgctccatccctcgctccttctcctacctcctcttcgacatcctcgtctcctcctccctctaccccctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40200 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggttatagcccacgagtgcggccaccacgccttcagcgactac

SEQ ID NO: 40201 - DNA, 334 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40202 - DNA, 449 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggtccagcgcctgcttgccgccatcgtggctggcgatggcttgcccccccagcaggtggtggccatcgccagcaatggcggtggcaagcaggcgctggagagacctcaagaaagcaaacccacctcactgcttccaacgctccatccccccctccctcccccacccccccctccacatcctcgtccccccccccccccaccccccctccccagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40203 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagacacaaatcccacctcactgctcccaacgccccaccccccacccctcccccctcctcctcttcgacatcatcacctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40204 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcctcccccaccctctccctttccccgcctggcccctctactgggcctgccaaggctgcgtcctaacgggcctctgggtcatcgcccacgaatgcggccaccacgccttcagcgactac

SEQ ID NO: 40205 - DNA, 350 bp, Artificial
  Mutation in BnaC.FAD2.b introduced by TALE nuclease pair BnFAD2_T03
caggatccatgggtgcaggtggaagaatgcaagtctctcctccctccagctccaccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccccctcccttacctcgcctgacccctctactgggcctgccaaggctgcgtcctaacgggcctctgggtcatagcccacgagtgcggccaccacgccttcagcgactac

SEQ ID NO: 40206 - DNA, 357 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgacggagaactcaagaaagcaatcccaccgcactgcttcaaacgctccatcccacgctccttctcctcttcgacatcatcatctcctcctcggctcctccctctaccacctctccacagcctacttccctctcctccccccccctctcccttacctcgcctggcccctctactgggcctaccaaggctgcgtcctaacgggcctctgggtcatagcccacgagtgcggccaccacgccttcagcgactac

SEQ ID NO: 40207 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 40208 - DNA, 331 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaccgcgtcccctctgagacctcaagaaagcaatcccacctcactgcttcaaacgctccatccctcgctccttctcctacctcctcttcgacatcctcgtctcctcctccctctaccacctctccacagcctactcccctctcctccccccccctctcccttacctcgcctagcccccctactgggccggccaaggctgcgtcctaacgggcctctgcgtcatcgcccaccaatgcggctaccgcgccttcagcgcctac

SEQ ID NO: 40209 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccacctcactgcttcaaacgctccatcccccgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40210 - DNA, 424 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcaacagccgctggaccgttgctgtgccaggcccacggcttgcccccccagcaggtggtggccatcgccagcaatggcggtggcggagacctcaagaaagcaatcccacctcactgcttcagacgctccatcccacgctccttctcctctccgccttcatcacctcctcctcgtctcctccctctaccacctccccacagcctacttccctctcccttacctcgcctgacccctctactgggcctgccaaggctgcgtcctaacgggcctctgggtcatagcccacgagtgcggccaccacgccttcagcgactac

SEQ ID NO: 40211 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccttagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40212 - DNA, 325 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtatagaacccaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 40213 - DNA, 358 bp, Artificial
  Mutation in BnaC.FAD2.b introduced by TALE nuclease pair BnFAD2_T03
cagtatccatgggtgcaggtggaagaatgcaagtctctcctccctccagctcccccgaaaccaaaaccctcaaacgcgtcccctgcgagacaccacccttcactctcggtttcccgactggaaagcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40214 - DNA, 333 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgaactcaagaaagcaatcccacctcactgcttcaaacgctcgatccctcgctccttctcctcttcgacaacatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40215 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaacgggcctctgggtcatcgcccacgaatgcggccaccacgccttcagcgactac

SEQ ID NO: 40216 - DNA, 327 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcctcgtctcctcctccctctaccacctctccacagcctacttccctctcccttgcctcgcctgacccctctactgggccggccaaggctgcgtcctaacgggcctctgggtcatagcccacgagtgcggccaccacgccttcagcgactac

SEQ ID NO: 40217 - DNA, 335 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtgaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40218 - DNA, 292 bp, Artificial
  Mutation in BnaC.FAD2.b introduced by TALE nuclease pair BnFAD2_T03
caggatccatgggtgcaggtggaagaatgcaagtctctaccccctccagctcccccggaaccaacaccctcaaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40219 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40220 - DNA, 410 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacaggcccacggcttgaccccccagcaggtggtggccatcgccagcaataatggtggcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgactggcccctctactgggcctgccaaggctgcgtcctaacgggcctctgggtcatcgcccacgaatgcggccaccacgccttcagcgactac

SEQ ID NO: 40221 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgcctgcagcgactac

SEQ ID NO: 40222 - DNA, 350 bp, Artificial
  Mutation in BnaC.FAD2.b introduced by TALE nuclease pair BnFAD2_T03
caggatccatgggtgcaggtggaagaatgcaagtgtctcctcactccaaaaagtctgaaaccgacaacatcaagcgcgtaccctgcgagacaccgcccttcactgaagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40223 - DNA, 302 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctcggctcctcccccaccctctcccttacctcgcctggcccctctactgggcctgccaaggctgcgtcctaacgggcctctgggtcatcgcccacgaatgcggccaccacgccttcagcgactac

SEQ ID NO: 40224 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 40225 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgccccatcccacgccccttctcctcttcgccatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40226 - DNA, 346 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaagaactcaagaaagcaatctcacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40227 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccacgcctggcccctctactgggcctgccaaggctgcgtcctaacgggcctctgggtcatcgcccacgaatgcggccaccacgccttcagcgactac

SEQ ID NO: 40228 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaaggttgcgtcctaaccggcgtctgggtcatagcccacgagtgcggccaccacgccttcagcgactac

SEQ ID NO: 40229 - DNA, 337 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccaccattcactctaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 40230 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgccccatcccacgctccttctcctcttcgacatcatcatctcctcctcggctcctccctctaccacctctccacagcctacttccctctcatcccccaccctctcccttacctcgcctggcccctctactgggcctgccaaggctgcgtcctaacgggcctctgggtcatcgcccacgaatgcggccaccacgccttcagcgactac

SEQ ID NO: 40231 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccacctcactgcttcaaacgctccatccctcgctccttctcctacctcctcttcgacatcctcgtctcctcctccctctaccacatctccacagcctacttccctctcctcccccaccctctcccttacctcgcctggcccctctactgggcctgccaaggctgcgtcctaacgggcctctgggacatcgcccacgaatgcggccaccacgccttcagcgactac

SEQ ID NO: 40232 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactgacctcaagaaagcaatcccaccccactgcttccaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40233 - DNA, 334 bp, Artificial
  Mutation in BnaC.FAD2.b introduced by TALE nuclease pair BnFAD2_T03
caggatccatgggtgcaggtggaagaatgcaagtgtctcctccctccagctccaccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40234 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccccgcgagacaccaccattcacacctcaagaaagcaatcccacctcactgcttcaaccgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 40235 - DNA, 372 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagcggctgttgccggtgctgtgccaggcccccgctcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 40236 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 40237 - DNA, 312 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40238 - DNA, 257 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 40239 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcccttaccgcgcctgacccctctactgggcctgccaaggctgcgtcctaacgggcctctgggtcatagcccacgagtgcggccaccacgccttcagcgactac

SEQ ID NO: 40240 - DNA, 369 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgaggcccacggcttgaccccggagcaggtggtggccatcgccagccacgatggagacctcaagaaagcaatcccacctcactgcttcaaacgctccatcccacgctccttctcctcttcgacatcatcatctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 40241 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgattcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40242 - DNA, 319 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactgcttcaaacgctccatccctcgctcattctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40243 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccgcccttcactgtcggggcggagaactcaagaaagcaatcccacctcactgcttcaaacgctccatcccacgctccttctcctcttcgacatcatcatctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40244 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40245 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctggggcatcgcccacgagtgcggccaccacgccttcagcgactac

SEQ ID NO: 40246 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcacaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40247 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40248 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgaatgcggccaccacgccttcagcgactac

SEQ ID NO: 40249 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40250 - DNA, 265 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatcccacgctccttctcctcttcgacatcatcatctcctcctcggctcctccctctaccacctctccacagcctacttccctctcccttacctcgcctgaccactctactgggcctgccaaggctgcgtcctaacgggcctctgggtcatagcccacgagtgcggccaccacgccttcagcgactac

SEQ ID NO: 40251 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgatacaccaccattcactcaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40252 - DNA, 257 bp, Artificial
  Mutation in BnaC.FAD2.b introduced by TALE nuclease pair BnFAD2_T03
caggatccatgggtgcagttggaagaatgcaagtgtctcctccctccagctcccccggaaccaacaccctcaaacgcgtcccctgcgagacaccaccattcactctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40253 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcggcctaacgggcctctgggtcatagcccacgagtgcggccaccacgccttcagcgactac

SEQ ID NO: 40254 - DNA, 347 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccgcccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaacgggcctctgggtcatcgcccacgaatgcggccaccacgccttcagcgactac

SEQ ID NO: 40255 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 40256 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40257 - DNA, 394 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggacttcgctgctacccaaggttgccgggtgacgcacaccgtggaaacggatgaaggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40258 - DNA, 415 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcgccagccacgatggcggcaagcaggcgctggagacggtccagcggctgttgccggtgctgtgccagacctcaagaaagcaatcccaccgcactgcgtcaaacgcaccatccctcgctccttctcctacctcctcttcgacatcctcgtctcctcctccctctaccacctctccacagcctacttccctcccctcccccaccctctcccttgcctcgcctggcccctctactgggcctgccaaggctgcgtcctaacgggcctctgggtcatcgcccacgaatgcggccaccacgccttcagcgactac

SEQ ID NO: 40259 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 40260 - DNA, 442 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccaccattcactctcgggtgttggcttaacgcaacgatgtgcgcgtgtgtaaacccgtggccgaccagtgcctcgtggtgcaggtggtggccatcgccagccacgatggcggcaagcaggcgctggagagacctcaagaaagcaatcccacctcactgcttcaaacgctccatcccacgctccttctcctctgcgacatcatcgtctcctcctccctctaccacctctccacagcctacttccctctcccttacctcgcctgacccctctactgggcgtgccaaggctgcgtcctaacgggcctctgggtcatagcccacgagtgcggccaccacgccttcagcgactac

SEQ ID NO: 40261 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcggcctaacgggcctctgggtcatcgcccacgaatgcggccaccacgccttcagcgactac

SEQ ID NO: 40262 - DNA, 283 bp, Artificial
  Mutation in BnaC.FAD2.b introduced by TALE nuclease pair BnFAD2_T03
caggatccatgggtgcaggtggaagaatgcaagtgtctcctccctcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 40263 - DNA, 346 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40264 - DNA, 337 bp, Artificial
  Mutation in BnaC.FAD2.b introduced by TALE nuclease pair BnFAD2_T03
caggatccatgggtgcaggcggaagaatgcaagtgtctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40265 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagaccccaagaaagcaatcccacctcactgcttcaaacgctccctcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40266 - DNA, 319 bp, Artificial
  Mutation in BnaC.FAD2.b introduced by TALE nuclease pair BnFAD2_T03
caggatccatgggtgcaggtggaagaatgcaagtatatcctccctccaaaaagcctgaaaccgacaacatcaagcgcgtaccctgcgagacaccgcccttcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40267 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaacctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctccccacagcctacttccctctccccccccaccctctcccttacctcgcctggcccctctactgggcctgccagggctgcgtcctaaccggcgtctgggtcatagcccacgagtgcggccaccacgccttcagcgactac

SEQ ID NO: 40268 - DNA, 338 bp, Artificial
  Mutation in BnaC.FAD2.b introduced by TALE nuclease pair BnFAD2_T03
caggatccatgggtgcaggtggaagaatgcaagtctctcctcactccagctcccccggaaccaacaccctcaaacgcgtcccctgcgagacaccaccattcacttcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40269 - DNA, 403 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgctggcgatggccaccacctgctggggggtcaagccgtgggcctggcacagcaccggcaacagccgctggacccacctcactgcttcaaacgctccatccctcgctccttctcctacctcctcttcgccatcctcgtctcctcccccctctaccacctctccacagcctacctccctcccctcccccaccctctcccttcccccgcctggcccctctactgggcctgccaaggctgcgtcctaacgggcctctgggtcatagcccacgagtgcggccaccacgccttcgcgactac

SEQ ID NO: 40270 - DNA, 336 bp, Artificial
  Mutation in BnaC.FAD2.b introduced by TALE nuclease pair BnFAD2_T03
caggatccatgggtgcaggtagaagaatgcaagtgtctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40271 - DNA, 397 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgccagccacgatggcggcaagcaggcgctggagacggtccagcggctgttgccggtgctgagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcggcctaacgggcctctgggtcatcgcccacgaatgcggccaccacgccttcagcgactac

SEQ ID NO: 40272 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 40273 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgtggccaccacgccttcagcgactac

SEQ ID NO: 40274 - DNA, 307 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccatgctccttaagaaagcaatcccacctcactgcttcaaacgctccatcccacgctccttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcagcgactac

SEQ ID NO: 40275 - DNA, 348 bp, Artificial
  Mutation in BnaC.FAD2.b introduced by TALE nuclease pair BnFAD2_T03
caggatccatgggtgcaggtggaagaatgcaagtctcccctccctccagctcccccgaaaccaaaaccctcaaacgcgtcccctgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgacttcagcgactac

SEQ ID NO: 40276 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagactgcgtcctaacgggcctctgggtcatagcccacgagtgcggccaccacgccttcagcgactac

SEQ ID NO: 40277 - DNA, 277 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtacttcaagtgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40278 - DNA, 432 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactcaggctccgcccccctgacgagcatcacaaaaatcgacgctcaagtcagaggtggcgaaacccgacaggactataaagataccaggcgtttccccctcaagaaagcaatcccacctcactgcttcaaacgctccatcccacgctccttctcccctccgacatcctcgtctcctcctccctctaccacctctccacagcctacttccctctcctccccccccctctcccttacctcgcctggcctctctactgggcctgccaagggtgcgtcctaacgggcctctgggtcatcgcccacgaatgcggccaccacgccttcagcgactac

SEQ ID NO: 40279 - DNA, 379 bp, Artificial
  Mutation in BnaC.FAD2.b introduced by TALE nuclease pair BnFAD2_T03
caggatccatgggtgcaggtggaagaatgcaagtctctcctcactccagctcccccgaaaccaaaaccctcaaacgcgtcccctgcgagacaccacccttcactcttgaacgctctcctgagtaggacaaatccgctccctcaagaaagcaatcccacctcactgcttcaaacgctccatccctcgctccttctcctacctcctcttcgacatcctcgtctcctcctccctctaccacctctccacagcctacttccctctcctcccccaccatctcccttaccgcgcctggcccctctactgggcctgccaaggctgcggcctaacgggcctctgggtcatcgcccacgaatgcggccaccacgccttcagcgactac

SEQ ID NO: 40280 - DNA, 369 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgaggcccacggcttgaccccggagcaggtggtggccatcgccagccacgatggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40281 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccacctcactgcttcaaacgctccatctctcgctccttctcctacctcctcttcgacatcctcgtctcctcctccctctaccacatctccacagcctacttccctctcctccccctccctctcccttacctcgcctggcccctctactgggcctgccaagggtgcgtcctaaccggcgtccgggtcatagcccacgagtgcggccaccacgcattcagcgactac

SEQ ID NO: 40282 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 40283 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctccccaaccctctcccttacctcgcctggcccctctactgggcctgccaaggctgcgtcctaacgggcctctgggtcatcgcccacgaatgcggccaccacgccttcagcgactac

SEQ ID NO: 40284 - DNA, 366 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactatcaggggataacgcaggaaagaacatgtgagcaaaaggccagcaaatctaccacctcactgcttcaaacgctccatcccacgctccttctcctcttcgacatcatcatctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 40285 - DNA, 334 bp, Artificial
  Mutation in BnaC.FAD2.b introduced by TALE nuclease pair BnFAD2_T03
caggatccatgggtgctggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40286 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcacacctcactgcttcaaacgctccatcccccgctccttctccacttcgccatcatcatctcctcctcggctcctccctctaccacctctccacagcctacttccctctcccttacctcgcctggcccctctacggggcctgccaaggctgcgtcctaacgggcctctgggtcatcgcccacgaatgcggccaccacgccttcagcgactac

SEQ ID NO: 40287 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 40288 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttaaagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 40289 - DNA, 334 bp, Artificial
  Mutation in BnaC.FAD2.b introduced by TALE nuclease pair BnFAD2_T03
caggatccatgggtgcaggtggaagaatgcaagtgtctactccctccaaaaagtctgaaaccgacaacatcaaacgcgtcccctgcgagacaccaccattcactcgaccccaagaaagcaatcccacctcactgcttcaaacgctccatcccacgctccttctcctcttcgacatcatcatctcctcctcggctcctccctctaccacctctccacagccttcttccctctcccttacctcgcctgacccctctactgggcctgccaaggctgcgtcctaacgggcctctgggtcatagcccacgagtgcggccaccacgcctgcagcgactac

SEQ ID NO: 40290 - DNA, 349 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccaccattcactgagacctcaagaaagcaatcccacctcactgcttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40291 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgagtgcggccaccacgccttcagcgactac

SEQ ID NO: 40292 - DNA, 342 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagccaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 40293 - DNA, 346 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggcggcgtcctaacgggcctcggggtcatcgcccacgaatgcggccaccacgccttcagcgactac

SEQ ID NO: 40294 - DNA, 351 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgcaagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgaccacgaatgcggccaccacgccttcagcgactac

SEQ ID NO: 40295 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccaccgcactgcttcaaacgctccatccctcgctccttctcctacctcctcttcgacatcctcgtctactcctccctctaccacctctccacagcctacttccctctcctcccccaccctctcccttacctcgcctggcccctctactgggcctgccaaggctgcggcctaacgggcctctgggtcatcgcccacgaatgcggccaccacgcctacagcgactac

SEQ ID NO: 40296 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcggcctaaccggcgtctgggtcatagcccacgagtgcggccaccacgccttcagcgactac

SEQ ID NO: 40297 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgcctac

SEQ ID NO: 40298 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 40299 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcacccgaaaccaaaaccctcaaacgcgtcccctgcgagacaccacccttcacgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagtccacgagtgcggccaccacgccttcagcgactac

SEQ ID NO: 40300 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactggagacctcaagaaagcaatcccacctcactgcttcaaacgctccatcccacgctccttctcctcttcgacatcatcatctcctcctcggctcctccctctaccacatctccacagcctacttccctctcccttacctcgcctgacccctctactgggcctgccaaggctgcgtcctaacgggcctctgggtcatagcccacgagtgcggccaccacgccttcagcgactac

SEQ ID NO: 40301 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40302 - DNA, 294 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccacctcactgcttcaaacgctccatccctcgctccttctcctacctcctcttcgacatcctcgtctcctcctccctctaccacctctccacatcctacttccctctcctcccccaccctctcccttacctcgcctggcccctctactgggcctgccagggctgcgtcctaaccggcgtctgggtcatagcccacgagtgcggccaccacgcctcagcgactac

SEQ ID NO: 40303 - DNA, 313 bp, Artificial
  Mutation in BnaC.FAD2.b introduced by TALE nuclease pair BnFAD2_T03
caggatccatgggtgcaggtggaagaatgcaagtctctcatccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctcaccctctctcctacttcgcctggcctctctactgggcctgccaagggtgcggcctaaccggcgtctgggtcatagcccacgagtgcggccaccacgccttcagcgactac

SEQ ID NO: 40304 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcggcctaacgggcctctgggtcatagcccacgagtgcggccaccacgccttcagcgactac

SEQ ID NO: 40305 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 40306 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcatcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40307 - DNA, 345 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40308 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactggaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40309 - DNA, 349 bp, Artificial
  Mutation in BnaC.FAD2.b introduced by TALE nuclease pair BnFAD2_T03
caggatccatgggtgcaggtggaagaatgcaagtctctactcactccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 40310 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcactgagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40311 - DNA, 449 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcacaccacctgctccggggtcaagccgtgggcctggcacagcaccggcaacagcgcctgcaccgtctccagcgcctgcttgccaccaatattgctggcgatggccaccacctgctccggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 40312 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatcccacgctccttctcctcttcgacatcatcatctcctcctcggctcctccctctaccacctctccacagcctacttacctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40313 - DNA, 419 bp, Artificial
  Mutation in BnaC.FAD2.b introduced by TALE nuclease pair BnFAD2_T03
caggatccatgggtgcaggtggcagaatgcaagtgtctcctccctccagctccaccgaacccaaaaccctcaaacgcgtcccctgcgagacaccaccattcactctctccaacgcctgcttgccggtgctgtgccaggcccacggcttgaccccccagcaggtggtggccatcgccagcaataatggggagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctatcgggcctctgggtcatcgcccacgaattcgtccaccacgccttcagcgactac

SEQ ID NO: 40314 - DNA, 348 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40315 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtcttggtcatagcccacgagtgcggccaccacgccttcagcgactac

SEQ ID NO: 40316 - DNA, 377 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgtaatctggaacatcgtatgggtaatcgatgaccttacgtttaaactcaagaaagcaatcccaccgcactgtttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40317 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagagactac

SEQ ID NO: 40318 - DNA, 411 bp, Artificial
  Mutation in BnaC.FAD2.b introduced by TALE nuclease pair BnFAD2_T03
caggatccatgggtgcaggtggaagaatgcaagtctcacctccctccagctcccccgaaaccaaaaccctcaaacgcgtcccctgcgagacaccacccttcactctcggagcaggtggtggccatcgccagcaatattggtggcaagcaggcgctggagacggtgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 40319 - DNA, 329 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgccctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40320 - DNA, 337 bp, Artificial
  Mutation in BnaC.FAD2.b introduced by TALE nuclease pair BnFAD2_T03
caggatccatgggtgcaggtggaagaatgcaagtctctactccctccagctccaccggaaccaacaccctcaaacgcgtcccctgcgagacaccaccattcactctaagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40321 - DNA, 292 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaaagcaatcccacctcactgcttcaaacgctccatcccacgctccttctcctcttcgacatcatcatctcctcctcggctcctccccctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40322 - DNA, 335 bp, Artificial
  Mutation in BnaC.FAD2.b introduced by TALE nuclease pair BnFAD2_T03
caggatccatggggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40323 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagaaagcaatcccacctcactgcttcaaacgctccatcccacgctccttctcctcttcgacatcatcatctcctcctcggctcctccctctaccacctctccacagcctacttccctctcccttacctcgcctaacccctctactgggcctgccaaggctgcgtcctaacgggcctctgggtcatagcccacgagtgcggccaccacgccttcagcgactac

SEQ ID NO: 40324 - DNA, 343 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40325 - DNA, 335 bp, Artificial
  Mutation in BnaC.FAD2.b introduced by TALE nuclease pair BnFAD2_T03
caggatccatgggtgcaggtggaagaatgcaagtctctcctccctccagctccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40326 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccttagacctcaagaaagcaatcccccctccctgcttcaaacgctccctccctcgctccttctcctacctcctcttcgacatcctcgcctcctcctccctctaccacctctccccagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40327 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40328 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcggcctaacgggcctctgggtcatagcccacgagtgcggccaccacgccttcagcgactac

SEQ ID NO: 40329 - DNA, 419 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcccacggcttgaccccacagcaggtggtggccatcgccagcaataatggtggcaagcaggcgctggagacctcaagaaagcaatcccacctcactgcttcaaacgctccatccctcgctacttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 40330 - DNA, 371 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcgggtcagggtgccggccttgatcatctcgccgccagaactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40331 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 40332 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgacctcaagaaagcaatcccacctcactgcttcaaacttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 40333 - DNA, 365 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctcttgatccggcacaaaaaccaccgctacctcaagaaagcgattccacctcactgcttcaaacgctccatcccacgctccttctcctcttcgccatcatcatctcctccccggctcctccctctaccacctctccacagcctcctaccctctcccttacctcgcctggcccctctactgggcctgccaaggctgcgtcctaacgggcctctgggtcatcgcccacgaatgcggccaccacgccttcagcgactac

SEQ ID NO: 40334 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccgacaccatcaagcgcgtaccctgcgagacaccgcccttcactgtcagaactcaagaaagcaatcccaccgcactgtttcaaacgctcgatccctcgctctttctcctacctcctcttcgacatcctcgtctcctcctccctctaccacctctccacagcctacttccctctcatcccccaccctctcccttacctcgcctggcccctctactgggcctgccaaggctgcgtcctaacgggcctctgggtcatagcccacgagtgcggccaccacgccttcagcgactac

SEQ ID NO: 40335 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaaacgcgccccctgttatcgagacctcaagaaagcaatcccacctcactgcttcaaacgctccatcccacgccccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40336 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 40337 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 40338 - DNA, 402 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggctgttgccggtgctgtgccaggcccacggcttgaccccccagcaggtggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaactggcctctgggtcatcgcccacgaatgcggccaccacgccttcagcgactac

SEQ ID NO: 40339 - DNA, 432 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcctggagacggtccagcggctgttgccggtgctgtgccaggcccacggcctgacccccgagcagctggtggccatcgccagccacgatggcggcgacctcaagaaagcaatcccacctcactgcttccaacgctccatcccacgctccttctccgctccgacttcatcacctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40340 - DNA, 331 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 40341 - DNA, 434 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagcgcctgcttgccgccatcgtggctggcgatggccaccacctgctccggggtcaagccgtgggcctggcacagcaccggcaacagccgctggacggagacctcaagaaagcaatcccacctcactgcttcaaacgctccatcccccgctccttcccctcttcgacatcatcacctcctcctcggctcctccctctcccacctctccacagcctacttccctctcccttacctcgcctgacccctctactgggcctgccaaggctgcgtcctagcgtgcctctgggtcatagcccacgagggcggcgaccgcgccttgagcgactac

SEQ ID NO: 40342 - DNA, 351 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctcattctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40343 - DNA, 326 bp, Artificial
  Mutation in BnaC.FAD2.b introduced by TALE nuclease pair BnFAD2_T03
caggatccatgggtgcaggtggaagaatgcaagtctctcctcactccagctcccccggaaccaacaccctcaaacgcgtcccctgcgagacaccaccattctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40344 - DNA, 391 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctaggcgacgaggtggtcgttggtcaacgcggccaacgcctggacacctcaagaaagcaatcccacctcactgcttcaaacgctccatccctcgctccttctcctacctcctcttcgacatcctcttctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40345 - DNA, 333 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcaagacaccaccattcactctcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40346 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcggcctaacgggcctctgggtcatagcccacgagtgcggccaccacgccttcagcgactac

SEQ ID NO: 40347 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcgtcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40348 - DNA, 362 bp, Artificial
  Mutation in BnaC.FAD2.b introduced by TALE nuclease pair BnFAD2_T03
caggatcctgggtgcaggtggaagaatgcaagtctctcctccctccagctcccccggaaccaacaccctcaaacgcgtcccctgcgagacaccaccattcactctcgcggcgggtgtcgtggttacgcgcaaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40349 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaagcgcgtaccctgcgagacaccgcccttcaccgaactcaagaaagcaatcccaccgcactgtttcaaacgctcgatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40350 - DNA, 330 bp, Artificial
  Mutation in BnaC.FAD2.b introduced by TALE nuclease pair BnFAD2_T03
caggatccatgggtgcaggtggaagaatgcaagtctctccaccctccagctcccccgaaacaaaaaacctcaaacgcgtcccctgtagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggtctctctactgggcctgccagggctgcgtcctagccggcttctgggtcatagcccacgagtgcggccaccacgccttcagcaactac

SEQ ID NO: 40351 - DNA, 367 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgagcgccatctcgaaccgacgttgctggccgagacctcaagaaagcaatcccacctcactgcttcaaacgctccatccctcgctccttctcctacctcctcttcgacatcctcgtctcatcctccctctaccacctctccacagcctacttccctctcccttacatcgcctgacccctctactgggcctgccaaggctgcgtcctaacgggcctctgggtcatagcccacgagtgcggccaccacgccttcagcgactac

SEQ ID NO: 40352 - DNA, 354 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatcccacgctccttctcctcttcgacatcatcatctcctcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40353 - DNA, 343 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctagacctcaagaaagcaatcccacctcactgcttcaaacgctccatccctctctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40354 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctaaagcaatcccacctcactgcttcaaacgccccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40355 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatgctccttaagaaagcaatcccacctcactgcttcaaacgctccatcccacgctccttctcctcttcgacatcatcatctcctcctcggctcctccctctaccacctctccacagcctacttccctctcctcccccacccgctcccttacctcgcctggcccctctactgggcctgccaaggctgcgtcctaacgggcctctgggtcatcgcccacgaatgcggccaccacgcctgcagcgactac

SEQ ID NO: 40356 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcttcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcgcacgaatgcggccaccacgccttcagcgactac

SEQ ID NO: 40357 - DNA, 321 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgactcaagaaagcaatcccaccgcactgtttcaaacgctcgatccctcgctctttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40358 - DNA, 347 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40359 - DNA, 331 bp, Artificial
  Mutation in BnaC.FAD2.b introduced by TALE nuclease pair BnFAD2_T03
caggatccatgggtgcaggtggaagaatgcaagtctcacctcccctcagctcccccgaaaccaaaaccctcaaccgcgtcccctatagacctcaagaaagcaatcccacctcactgcatcaaacgctacatcccacgctccttctcctcttcgacagcatcatcccctcctcggctcctccctctaccacctctccacagcctacttccatctcctcccccaccctctcccttacctcgcctggccccactactgggcctgccaaggctgcgtcctaacgggcctcgggggcatcgcccacgaatgcggccaccacgccttcagcgactac

SEQ ID NO: 40360 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgacctcaagaaagcaatcccacctcactgcttcaaacgctccatccctcgctccttctcctacctcctcttcgacatcctcgtctcctcctcccgctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 40361 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccccagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40362 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttacctcactgcttcaaactctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40363 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 40364 - DNA, 420 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtgttgtgccaggcccacggcttgaccccggagcaggtggtggccatcgccagccacgatggcggcaacagccgctggacccagacctcaagaaagcaatcccacctcactgcttcaaacgctccatcccacgctccttctcctcttcgacatcatcatctcctcctcggctcctccctctaccacctccccacagcctacttccctctcccttacctcgcctgacccctctactgggcctgccaaggctgcgtcctaacgggcctctgggtcatagcccacgagtgcggccaccacgccttcagcgactac

SEQ ID NO: 40365 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaatgcgtcccctgcgagacaccacccttcactatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40366 - DNA, 349 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttatcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40367 - DNA, 316 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacctcaagaaagcaatcccacctcactgcttcaaatgctccatccctcgctccttctcctacctcctcttcgacatcctcgtctcctcctccctctaccacctctccacagcctacttccctctcccttacctcgcctgacccctctactgggcctgccaaggctgcgtccaaacgggcctctgggtcatagcccacgagtgcggccaccacgccttcagcgactac

SEQ ID NO: 40368 - DNA, 310 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccatcaaacgcgtcccctgcgagacaccaccatcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40369 - DNA, 335 bp, Artificial
  Mutation in BnaC.FAD2.b introduced by TALE nuclease pair BnFAD2_T03
caggatccatgggtgcaggtggaagaatgcaagtgtatactccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggcggcgtcctaacgggcctctgggtcatagcccacgagtgcggccaccacgccttcagcgactac

SEQ ID NO: 40370 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgctgcaaacgctccatccctcgctccttctcatacctcctcttcgacatcctcgtctcctcctccctctaccacctctccacagcctacttccctctcctcccccaccctctcccttacctcgcctggtccctctactgggcctgccaaggctgcgtcctaacgggcctctgggtcatcgcccacgaatgcggccaccacgccttcagcgactac

SEQ ID NO: 40371 - DNA, 408 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggggggaaagccggcgaacgtggcgagaaaggaagggaagaaagcgaaaggagcgggcgctaggagacctcaagaaagcaatcccacctcactgcttcaaaccctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40372 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtaccctgcgagacaccaccattagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40373 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagggcggccaccacgccttcagcgactac

SEQ ID NO: 40374 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaccgcgtcccctgcgagacaccaccattcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40375 - DNA, 306 bp, Artificial
  Mutation in BnaC.FAD2.b introduced by TALE nuclease pair BnFAD2_T03
caggatccatgggtgcaggtgaaagaatgcaagtctcaaccccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcggcctaacgggcctctgggtcatcgcccacgaatgcggccaccacgccttcagcgactac

SEQ ID NO: 40376 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccacccttcactccacctcactgcttcaaacgcgccatccctcgctccttctcctacctcctctccgacatcctcgtctcctcccccctctaccacctcgccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40377 - DNA, 336 bp, Artificial
  Mutation in BnaC.FAD2.b introduced by TALE nuclease pair BnFAD2_T03
caggatccatgggtgcaggtgaaagaatgcaagtctctactccctccagctcccccgaaaccaacaccctcaaacgcgtcccctgcgagacaccaccattcactctagacctcaagaaagcaatcccacctcactgcttcaaacgctccatcccacgctccttctcctcttcgccatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40378 - DNA, 362 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgctgcgtaacatcgttgctgctccagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40379 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 40380 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgaatgcggccaccacgccttcagcgactac

SEQ ID NO: 40381 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40382 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctaaaacgcgtcccctgcgagacaccacccttcactcaagacctcaagaaagcaatcccacctcactgcttcaaacgctccatccctcgctccttcacctacctcctcttcgacatcctcgtctcctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 40383 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 40384 - DNA, 378 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcctgcttgccaccgccattgctggcgatggccaccacctttgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 40385 - DNA, 331 bp, Artificial
  Mutation in BnaC.FAD2.b introduced by TALE nuclease pair BnFAD2_T03
catgatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40386 - DNA, 337 bp, Artificial
  Mutation in BnaC.FAD2.b introduced by TALE nuclease pair BnFAD2_T03
caggatccatgggtgcaggtggaagaatgcaagtctctaccccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40387 - DNA, 315 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaactcctccctcggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40388 - DNA, 318 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40389 - DNA, 334 bp, Artificial
  Mutation in BnaC.FAD2.b introduced by TALE nuclease pair BnFAD2_T03
caggatccatgggtgcaggtggcagaatgcaagtctcacctccctccagctcccccggaaccaacaccctcaaacgcgtcccctgcgagacaccaccattcactagacctcaagaaagcaatcccacctcactgcttcaaacgctccatcccaccctccttctcctcttcgacatcatcatctcctcctcggctcctccctctaccacctctccacagcctacttccctctcccttacctcgcctgacccctctactgggcctgccaaggctgcgtcctagcgggcctctgggtcataggccacgagtgcggccaccacgccttcagcgactac

SEQ ID NO: 40390 - DNA, 337 bp, Artificial
  Mutation in BnaC.FAD2.b introduced by TALE nuclease pair BnFAD2_T03
caggatccatgggtgcaggtggaagaatgcaagtgtcacctccctccagctcccccggaaccaacaccctcaaccgcgtcccctgcgagacaccaccattcactcagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcggcctaacgggcctctgggtcatagcccacgagtgcggccaccacgccttcagcgactac

SEQ ID NO: 40391 - DNA, 331 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccacccttcacgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40392 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40393 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgtgtcctaacgggcctctgggtcatagcccacgagtgcggccaccacgccttcagcgactac

SEQ ID NO: 40394 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccctcccaccctccttctcctcttcgccatcatcatctcctcctcgcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40395 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaatcctcaaacgcgtcccctgcgagacaccacccttcactcgacctcaagaaagcaatcccacctcactgcttcaaacgctccatccctcgctccttctcctacctcctcttcgacatcctcgtctcctcccccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 40396 - DNA, 351 bp, Artificial
  Mutation in BnaC.FAD2.b introduced by TALE nuclease pair BnFAD2_T03
caggatccatgtgtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40397 - DNA, 309 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaagaaagcaatcccacctcactgcttcaaacgctccatcccacgctccttctcctcttcgacatcatcatctcctcctcggctcctccctctaccccctctccacagcctacttccctctcctcccccaccctcgcccttacctcgcctggcccctctactgggcctgccaaggctgcgtcctaacgggcctctgggtcatcgcccacgaatgcggccaccacgccttcagcgactac

SEQ ID NO: 40398 - DNA, 396 bp, Artificial
  Mutation in BnaC.FAD2.b introduced by TALE nuclease pair BnFAD2_T03
caggatccatgggtgcaggtggaagaatgcaagtgtctcctcactccaaaaagtctgaaaccgacaccatcaagcgcgtaccctgcgagacaccgcccttcactgtgtacgtgccccacgagtacatcgagctgatcgagatcgcccggaacagcacccaggaccggagaactcaagaaagcaatcccaccgcactgtttcaaacgctcgatccctcgctccttctcctacctcctcttcgacatcctcgtctcctcctccctctaccacctctccacagcctacttccctctcccttaccgcgcctgacccctctactgggcctgccaaggctgcgtcctaacgggcctctgggtcatagcccacgagtgcggccaccacgccttcagcgactac

SEQ ID NO: 40399 - DNA, 426 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacggtccagcggctgttgccggtgctgtgccaggcccacggcttgacccctcagcaggtggtggccatcgccagccatggcggcggcaggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40400 - DNA, 348 bp, Artificial
  Mutation in BnaC.FAD2.b introduced by TALE nuclease pair BnFAD2_T03
caggatccatgggtgcaggtgacagaatgcaagtctctcctccctccagctcccccggaaccaacaccctcaaacgcgtcccctgcgatacaccacccttcactcgacctcaagaaagcaatcccacctcactgcttcaaacgctccatccctcgctccttctcctacctcctcttcgacatcctcgtctcctcctccctctaccagctctccacagcctacttccctcccctcccccaccctctcccttacctagcctggcccctctactgggcctgccaaggctgcggcctaacgggcctctgggtcatcgcccacgaatgcggccaccacgccttcagcgactac

SEQ ID NO: 40401 - DNA, 415 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgatgggcaggttgtagccgccggagtaggccttggtgtccacgatcacgccgtagtcgatggggagacctcaagaaagcaatcccacctcactgcttcaaacgctccatccctcgctccttctcctacctcctcttcgacatcctcgtctcctcctccctctaccccctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40402 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40403 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaacctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40404 - DNA, 332 bp, Artificial
  Mutation in BnaC.FAD2.b introduced by TALE nuclease pair BnFAD2_T03
caggatccatgggtgcaggtggaagaatgcaagtgtctactccctccaaaaagactgaaaccgacaacatcaagcgcgtaccctgcgagacaccacccttcacagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 40405 - DNA, 266 bp, Artificial
  Mutation in BnaC.FAD2.b introduced by TALE nuclease pair BnFAD2_T03
caggatccatgggtgcaggtggaagaatgcaagtctcgacctcaagaaagcaatcccacctcactgcttcaaacgctccatcccacgctccttctcctcttcgacatcatcatctcctcctcggctcctccatctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40406 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtactaaccggcgtctgggtcatagcccacgagtgcggccaccacgccttcagcgactac

SEQ ID NO: 40407 - DNA, 344 bp, Artificial
  Mutation in BnaC.FAD2.b introduced by TALE nuclease pair BnFAD2_T03
caggatccatgggtgcaggtggaagaatgcaagtctcaacaccctacagctccaccgaaaccaaaaccctcaaacgagtcccctgcgagacaccacccttcactctgagacctcaagaaagccatcccacctcaatgcatcaaacgatccatccctcgctccttctcctacctcctcttcgacatcctcgtctcctcctcggctcctccctctaccacctctccacagcctacttccctctcccttacctcgcctcacccctctactgggcctgccaaggctgcgtgctaacgggcctctgggtcatagcccactagggcggccaccacgccttcagcgactac

SEQ ID NO: 40408 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40409 - DNA, 370 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcggggtcaagccgtgggcctggcacagcaccggcaacaggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 40410 - DNA, 379 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggggggtcaagccgtgggcctggcacagcaccggcaacagccgcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagggcggccaccacgccttcagcgactac

SEQ ID NO: 40411 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagctactac

SEQ ID NO: 40412 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40413 - DNA, 436 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaccccggagcaggtggtggccatcgccagcaatattggtggcaagcaggcgctggagacggtgcaggtggtggggtcaagccgtggagaactcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40414 - DNA, 330 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40415 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtgacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40416 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgtccacgaatgcggccaccacgccttcagcgactac

SEQ ID NO: 40417 - DNA, 370 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtgaacgctctcctgagtagaactcaagaaagcaatcccaccgcactgtttcaaacgctcgatccctcgctctttctcctacctcctcttcgacatcttcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40418 - DNA, 338 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctcgagacctcaagaaagcaatcccacctcactgcttcaaacgctccatccctcgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 40419 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgtagagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40420 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 40421 - DNA, 401 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcggccaccacctgctgaggggtcaagccgtgggcctggcacagcaccgccaacagccgctggaggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40422 - DNA, 337 bp, Artificial
  Mutation in BnaC.FAD2.b introduced by TALE nuclease pair BnFAD2_T03
caggatccatgggtgcaggtggaagaatgcaagtctctcctcactccagctcccccgaaaccaaaaccctcaaacgcgtcccctgcgagacaccacccttcactcttagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 40423 - DNA, 400 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctcggagacggtccagcggctgttgccggtgctgtgccaggcccacggtccagcggctgttgccggagacctcaagaaagcaatcccaccgcactgtttcaaacgctcgatccctcgctctttctcctcttcgacatcatcatctcctcctcggctcctccctctaccacctctccacagcctacttccctctcccttacctcgcctgaccccgctactgggcctgccaaggctgcgtcctaacgggcctctgggtcatagcccacgagtgcggccaccacgccttcagcgactac

SEQ ID NO: 40424 - DNA, 318 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 40425 - DNA, 338 bp, Artificial
  Mutation in BnaC.FAD2.b introduced by TALE nuclease pair BnFAD2_T03
caggatccatgggtgcaggtggaagaatgcaagtctctcctccctccagctccaacgaaaccaaaaccctcaaacgcgtcccctgcgagacaccacccttcactctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccatggctgcgtcctaacgggcctctgggtcatagcccacgagtgcggccaccaccccttcagcgactac

SEQ ID NO: 40426 - DNA, 319 bp, Artificial
  Mutation in BnaC.FAD2.b introduced by TALE nuclease pair BnFAD2_T03
caggatccatgggtgcaggtggaagaatgcaagtgtctccctcctccagctcccccggaaccaaaaccctcaaacgcgtcccctgcgagacaccacccttcactgcttcaaacgctccatccctcgctccttctcctccctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 40427 - DNA, 350 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccacccttcactcaagacctcaataaagcaatcccacctcactgcttcaaacgctccatccctcgctccttctcctacctcctcttcgacatcctcgtctcctcctccctctaccacctctccacagcctacttccctctcctcccccaccctctcccttgcctcgcctggcccctctactgggcctgccaaggctgcgtcctaacgggcctctgggtcatcgcccacgaatgcggccaccacgccttcagcgactac

SEQ ID NO: 40428 - DNA, 363 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccctcactctgcgatggcggcaagcaggcgctggagaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40429 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcgtccaccacgccttcagcgactac

SEQ ID NO: 40430 - DNA, 466 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggaccgagatagggttgagtgttgttccagtttggaacaagagtccactattaaagaacgtggactccaacgtcaaagggcgaaaaaccgtctatcagggcgatggttcacgtgagaactcaagaaagcaatcccacctcactgcttcaaacgctccatcccacgctccttcccctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40431 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctcattctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40432 - DNA, 392 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactcttgggcctggcacagcaccggcaacagccgctggaccgtctccagcgcctgcttgcgagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40433 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtccccttcgagacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggtccctctactgggcctgccaaggctgcgtcctaacgggcctctgggtcatcgcccacgaatgcggccaccacgccttcagcgactac

SEQ ID NO: 40434 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcggcctaacgggcctctgggtcatagcccacgagtgcggccaccacgccttcagcgactac

SEQ ID NO: 40435 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatcgcccacgaatgcggccaccacgccttcagcgactac

SEQ ID NO: 40436 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40437 - DNA, 414 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgttgcgcgtaaccaccacacccgccagcgccctagcgcccgctcctttcgctttcttcccttcctttctcgccacgttcgagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40438 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40439 - DNA, 334 bp, Artificial
  Mutation in BnaC.FAD2.b introduced by TALE nuclease pair BnFAD2_T03
caggatccatgggtgcaggtggaagaatgcaagtctctcctccctccagctccaccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcgtgccaaggctgcgacctaacgggcctctgggtcatcgcccacgaatgcgtccaccgcgcctgcagcgactac

SEQ ID NO: 40440 - DNA, 419 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactccggtccagcggctgttgccaccattattgctggcaatggccaccacctgctggggggtcaagccgtgggcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40441 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacgcacctcaagaaagcaatcccacctcactgcttcaaacgctccatccctcgctccttctcctacctcctcttcgacatcctcgtctcctcctccctctaccacctctccacagcctacttccctcgcctcccccaccctctcccttacctcgcctggcccctctactgggcctgccaaggctgcggcctaacgggcctctgggtcatcgcccacgaatgcggccaccacgccttcagcgactac

SEQ ID NO: 40442 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggtcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgcagcgactac

SEQ ID NO: 40443 - DNA, 368 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacggtccagcggctgttgccggtgctgtgccaggcccacggcttgaccccggagcaggtggtggccagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40444 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40445 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgctacaaacgctccatcccacgctccttctcctcttcgacatcatcatctcctcctcggctcctccctctaccacctctccacagcctacttccctctcccttacctcgcctgacccctctactgggcctgccaaggctgcgtcctgacgggcctctgggtcatagcccacgagtgcggccaccacgccttcagcgactac

SEQ ID NO: 40446 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccacccttcactcttacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaagcctgcgtcctatcgggcctctgggtcatagcccacgagtgcggccaccacgccttcagcgactac

SEQ ID NO: 40447 - DNA, 282 bp, Artificial
  Mutation in BnaC.FAD2.b introduced by TALE nuclease pair BnFAD2_T03
caggatccatgggtgcaggtggaagaatgcaagtctctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 40448 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcggcctaaccggcgtctgggtcatagcccacgagtgcggccaccacgccttcagcgactac

SEQ ID NO: 40449 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccacggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40450 - DNA, 342 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtcccctgcgagacaccaccctgacctcaagaaagcaatcccacctcactgcttcaaacgctccatccctcgctccttttcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40451 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagggcggccaccacgccttcagcgactac

SEQ ID NO: 40452 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccccctcctcccccaccctctcccttacctcgcctggcccctctactgggcctgccaaggctgcgtcctaacgggcctctgggtcatcgcccacgaatgcggccaccacgccttcagcgactac

SEQ ID NO: 40453 - DNA, 454 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggaccgtctcagcggctgttgccaccgccattgctggcgatggccaccacctgctggtagcggtggtttttttgtttgcaagcagcagattacgcgcagaaggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40454 - DNA, 322 bp, Artificial
  Mutation in BnaC.FAD2.b introduced by TALE nuclease pair BnFAD2_T03
caggatccatgggtgtaggtggaagaatgcaagtgtctcctccctccaagaagtctgaaaccgacaccatcaagcgcgtaccctgcgagacaccgcccttcactccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40455 - DNA, 358 bp, Artificial
  Mutation in BnaC.FAD2.b introduced by TALE nuclease pair BnFAD2_T03
caggatccatgggtgcaggtgcaagaatgcaagtctcccctcactccagctccaccggaaccaacaccctcaaacgcgtcccctgcgagacaccaccattcactctggcggcaagcaggcgctggaggagacctcaagaaagcaatcccacctcactgcttcaaacgctccatcccacgctccttctcctcttcgacatcatcatctcctcctcggctcctccctctaccacctctccacagcctacttcccgctcccttaccacgcctgacccctctacggggcgtgccaaggctgcgtcctaacgggcctctgggtcatagcccaggagtgcggccaccacgcctgcagcgactac

SEQ ID NO: 40456 - DNA, 344 bp, Artificial
  Mutation in BnaC.FAD2.b introduced by TALE nuclease pair BnFAD2_T03
caggatccatgggtgcaggtggaagaatgcaagtctctcccccctccagctcccccggaaccaacaccctcaaccgcgtcccctgcgagccaccaccattcactctcgggtcgtagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40457 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccggagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaaggctgcgtcctaacgtgcctctgggtcatcgcccacgaatgcggccaccacgccttcagctactac

SEQ ID NO: 40458 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40459 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatccaacctcactgcttcaaacgctccatccctcgctccttctcctacctcctcttcgccatcctcgtctcctcctccctctaccacctctccacagcctacttccctctcccttccctcgcctgacccctctactgggcctgccaaggctgcgtcctaacgggcctctgggtcatcgcccacgaatgcggccaccacgccttcagcgactac

SEQ ID NO: 40460 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgccccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccactaatgcggccaccacgccttcagcgactac

SEQ ID NO: 40461 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccatgccttcagcgactac

SEQ ID NO: 40462 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcctttttacggttcctctccctcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgtggccaccacgccttcagcgactac

SEQ ID NO: 40463 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaatgctgcgtcctaacgggcctctgggtcatagcccacgagtgcggccaccacgccttcagcgactac

SEQ ID NO: 40464 - DNA, 330 bp, Artificial
  Mutation in BnaC.FAD2.b introduced by TALE nuclease pair BnFAD2_T03
caggatccatggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccacactctcccttacctcgcctggcccctctactgggcctgccaaggctgcgtcctaacgggcctctgggtcatcgcccacgagtgcggccaccacgccttcagcgactac

SEQ ID NO: 40465 - DNA, 429 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttccagcgcctgcttgccaccattattgctggcgatggccaccacctgctggggggtcaagccgtgggcctggcacagcaacggcaacagccgaagacctcaagaaagcaatcccacctcactgcttcaaacgctccatcccacgctccttctcctctccgacatcatcatctcctcctcgtctcctccctctaccacctctccacagcctacttccctctcccttacctcgcctgacccctctactgggcctgccaaggctgcgtcctaccgggcctctgggtcatagcccacgagtgcggccaccacgccttcagcgactac

SEQ ID NO: 40466 - DNA, 410 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactagttgccggtgctgtgccaggcccacggcttgaccccccagcaggtggtggccatcgccagcagacctcaagaaagcaatcccacctcactgcttcaaacgctccatccctcgctccttctcctacctcctcttcgacatcctcgtctcctcctccctctcccacctctccacagcctacttccctctcctccccctccctctcccttacctcgcctggcccctctactgggcctgccaaggctgcgtcctaacgggcctctgggtcatcgcccacgaatgcggccaccacgccttcagcgactac

SEQ ID NO: 40467 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 40468 - DNA, 336 bp, Artificial
  Mutation in BnaC.FAD2.b introduced by TALE nuclease pair BnFAD2_T03
cagggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40469 - DNA, 335 bp, Artificial
  Mutation in BnaC.FAD2.b introduced by TALE nuclease pair BnFAD2_T03
caggatccatgggtgcaggtggaagaatgcaagtctatcctccctccagctccaccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccttccaaggcttcgtccgaacgggcctctgggtcatagcccacgagtgcggccgccacgcctcagcgactac

SEQ ID NO: 40470 - DNA, 321 bp, Artificial
  Mutation in BnaC.FAD2.b introduced by TALE nuclease pair BnFAD2_T03
caggatccatgggtgcaggtggaagaatgcaagtctcacctccctccagctcccccggaaccaaaaccctcaaacgcgtcccctgcgagacaccacccttcactctccatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40471 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 40472 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcctcgcccacgaatgcggccaccacgccttcagcgactac

SEQ ID NO: 40473 - DNA, 335 bp, Artificial
  Mutation in BnaC.FAD2.b introduced by TALE nuclease pair BnFAD2_T03
caggatccatggtgcaggtggaagaatgtaagtctctcatccctccagctcccccggaaccaacaccctcaaacgcgtcccctgagagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 40474 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttacctcaagaaagcaatcccacctcactgcttcaaacgccccatcccacgctccttctcctcttcgacatcatcatctcctcctcggctcctccctctaccacctctccacagcctacttccctctcccttacctcgcctgacccctctactgggcctgccaaggcggcgtcctaacggggctctgggtcatagcccacgagtgcggccaccacgccttcagcgactac

SEQ ID NO: 40475 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40476 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccatcaaacgcgtcccctgcgagacaccacccttcacagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40477 - DNA, 472 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctcgaggcagtgcatgcatggcgcaatgcactgacgggtgccccgctcaacttgaccccccagcaggtggtggccatcgccagcaataatggtggcaagcaggcgctggagacggtccagcgggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggcggcgtcctaacgggcctctgggtcatcgcccacgaatgcggccaccacgccttcagcgactac

SEQ ID NO: 40478 - DNA, 317 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40479 - DNA, 348 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccaccattcactgacctcaagaaagcaatcccacctcactgcttcaaacgctccatcccacgctccttctcctcttcgacatcatcatctcctcctcggctcctccctctaccacctctccacagcctacttccctctcctcccccaccctctcccttaccgcgcctggcccctctactgggcctgccaaggctgcggcctaacgggcctctgggtcatcgcccacgaatgcggccaccacgccttcagcgactac

SEQ ID NO: 40480 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcggcctagcgggcctctgggtcatcgcccacgaatgcggccaccacgccttcagcgactac

SEQ ID NO: 40481 - DNA, 338 bp, Artificial
  Mutation in BnaC.FAD2.b introduced by TALE nuclease pair BnFAD2_T03
caggatccatgggtgcaggtggaagaatgcaagtctctcctccctccagctccccggaaccaacaccctcaaacgcgtcccctgctagacaccaccattcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40482 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcttcctaacgggcctctgggtcatcgcccacgaatgcggccaccacgccttcagcgactac

SEQ ID NO: 40483 - DNA, 354 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccacctcactgcttcaaacgctccatcccacgctccttctcctcttcgacatcatcatctcctcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40484 - DNA, 264 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttgggcgactgc

SEQ ID NO: 40485 - DNA, 335 bp, Artificial
  Mutation in BnaC.FAD2.b introduced by TALE nuclease pair BnFAD2_T03
caggatccatgggtgcaggtgcaagaatgcaagtctctcctcacaccagctcccccggaaccaacagcctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40486 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgatacggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 40487 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccacctcgcctgcagcgactac

SEQ ID NO: 40488 - DNA, 334 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40489 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40490 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtaatcgcccacgaatgcggccaccacgccttcagcgactac

SEQ ID NO: 40491 - DNA, 410 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggaagaatttgtccactacgtgaaaggcctggcacagcaccggcaacagccgctggacgagacctcaagaaagcagtcccacctcactgcttcaaacgctccatccctcgctccttctcctacctcctcttcgacatcctcgtctcctcctccctctaccacctctccccagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40492 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccagggctgcgtcctaaccggcgtctgggtcatcgcccacgagtgcggccaccacgccttcagcgactac

SEQ ID NO: 40493 - DNA, 278 bp, Artificial
  Mutation in BnaC.FAD2.b introduced by TALE nuclease pair BnFAD2_T03
caggatccatgggtgcaggtggaagaatgcaagactctcctccctccagctcccccggaaccaaaaccctcaaacgcgtcccctgcgagacaccacccttcactctcgacatcctcgtctcctcctccctctaccacctctccacagcctacttccctctcctcccccaccctctcccttacctcccctggcccctctactgggcctgccaaggctgcgtcctaacgggcctctgggtcatcgcccacgaatgcggccaccacgccttcagcgactac

SEQ ID NO: 40494 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccatcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtccgaacgggcctctgggtcatagcccacgatttcggccaccacgccttcagcaactac

SEQ ID NO: 40495 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctccactgagccggccaagactgcgtcctaacgggcctctgggtcatagcccgcgagtgctgccaccacgccatcagcgactac

SEQ ID NO: 40496 - DNA, 333 bp, Artificial
  Mutation in BnaC.FAD2.b introduced by TALE nuclease pair BnFAD2_T03
caggatccatgggtgcaggtggaagaatgcaagtctctcatccctccagctcccccggaaacaacaccctcaaacgcgtcccctgcgagacaccaccattcactaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40497 - DNA, 445 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgtctccagcggctgttgccggtgctgtgccaggcccacggcttgaccctcagcaggtggtggccatcgccagcaatggcggtggcaagcaggcgctggagacggtccagcggagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccagggctgcgtcctaacgggcctctgggtcatcgcccacgaatgcggccaccacgccttcagcgactac

SEQ ID NO: 40498 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccatcagcgactac

SEQ ID NO: 40499 - DNA, 295 bp, Artificial
  Mutation in BnaC.FAD2.b introduced by TALE nuclease pair BnFAD2_T03
caggatccatgggtgcaggtggaagaatgcaagtctctcatccctccaggtagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 40500 - DNA, 347 bp, Artificial
  Mutation in BnaC.FAD2.b introduced by TALE nuclease pair BnFAD2_T03
caggatccatgggtgcaggtggaagaatgcaagtctctcatccctccagctcccccgaaaccaaaaccctcaaacgcgtcccctgcgagacaccacccttcactcgcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40501 - DNA, 295 bp, Artificial
  Mutation in BnaC.FAD2.b introduced by TALE nuclease pair BnFAD2_T03
caggatccatgggtgcaggtggaagaatgcaagtctctcatccccccaggtagacctcaagaaagcaatcccacctcactgcttcaaacgctccatccctcgctccttctcctacctcctcttcgacatccgcgtctcctcctccctctaccacctctccacagcctacttccctctcctccctcagcctctcccttacctcgcctggcccctctactgggcctgccaaggctgcgtcctaacgggcctctgggtcatcgcccgcgaatgcggcgaccacgccttcagcgactac

SEQ ID NO: 40502 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtcgaactcaagaaagcaatcccaccgcactgtttcaaacgctcgatccctcgctctttctcctacctcatctgggacatcatcatctcctcctctgctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40503 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctccctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40504 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcgactcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 40505 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggacctcaagaaagcaatcccacctcactgcttaaaacgctccatcccacgctccttctcctcttcgacatcatcatctcctcctcggctcctccctctaccacctctccacagcctacttccctctcccttacctcgcctgacccctctactgggcctgccaaggctgcggcctaacgggcctctgggtcatagcccacgagtgcggccaccacgccttcagcgactac

SEQ ID NO: 40506 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcggcctaacgggcctctgggtcatcgcccacgaatgcggccaccacgccttcagcgactac

SEQ ID NO: 40507 - DNA, 335 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctacaagacctcaagaaagcaatcccacctcactgcttcaaacgctccatcccacgctccttctcctcttcgacatcatcatctcctcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40508 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgaatgcggccaccacgccttcagcgactac

SEQ ID NO: 40509 - DNA, 335 bp, Artificial
  Mutation in BnaC.FAD2.b introduced by TALE nuclease pair BnFAD2_T03
caggatccatgggtgcaggtggaagaatgcaagtctatcatccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40510 - DNA, 321 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccataaaaagcaatcccacctcactgcttcaaacgctccatcccacgctccttctcctcttcgacatcatcctctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40511 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggccatagcccacgagtgcggccaccacgccttcagcgactac

SEQ ID NO: 40512 - DNA, 335 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40513 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcggaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcacgactac

SEQ ID NO: 40514 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacacgccatcccacgctccttctccgcttcgacatcatcacctcctcctcggctcctccctctaccacctctccacagcctacttccctctcccttgcctcgcctggcccctctactgggcctgccaaggctgcgtcctaaccggcctctgggtcatagcccacgagtgcggccaccacgccttcagcgactac

SEQ ID NO: 40515 - DNA, 342 bp, Artificial
  Mutation in BnaC.FAD2.b introduced by TALE nuclease pair BnFAD2_T03
caggatccatggttgcaggtggaagaatgcaagtgtctcctccatacaagaagactgaaaccgacaccatcaagcgcgtaccctgcgagacaccgcccttaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctagcccctctactgggcctgccaaggctgcgtcctaacgggcctctgggtcatcgcccacgaatgcggccaccacgccatcagcgactac

SEQ ID NO: 40516 - DNA, 349 bp, Artificial
  Mutation in BnaC.FAD2.b introduced by TALE nuclease pair BnFAD2_T03
caggatccatgggtgcaggtggaagaatgcaagtctctcctccgtccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40517 - DNA, 352 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcacctggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40518 - DNA, 395 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgggtcaagccgtgggcctggcacagcaccggcaacagccgctggagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 40519 - DNA, 354 bp, Artificial
  Mutation in BnaC.FAD2.b introduced by TALE nuclease pair BnFAD2_T03
caggatccatgggtgcaggtggaagaacgcaagtgtctcctccctccaaaaagtctgaaaccgacaacatcaagcgcgtaccctgcgagacaccacccttcactctgggaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40520 - DNA, 329 bp, Artificial
  Mutation in BnaC.FAD2.b introduced by TALE nuclease pair BnFAD2_T03
caggatccatgggtgcaggtggaagaatgcaagtgtctcatccctccaaaaagtctgaaaccgacaacatcaagcgcgtaccctgcgagacaccgcccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 40521 - DNA, 332 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 40522 - DNA, 349 bp, Artificial
  Mutation in BnaC.FAD2.b introduced by TALE nuclease pair BnFAD2_T03
caggatccatgggtgcaggtggaagaatgcaagtctctccctcctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcctcccccaccctctcccttgcctcgcctggcccctctactgggcctgccaagcctgcgtcctaacgggcctctgggtcatagcccacgagtgcggccaccacgccttcagcgactac

SEQ ID NO: 40523 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40524 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40525 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctccccccccctctcccttccctcgcctggcccctctactgggcctgccaaggctgcgtcctaacgggcctctgggtcatcgcccacgaatgcggccaccacgccttcagcgactac

SEQ ID NO: 40526 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40527 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctcaggaaagcaatcccacctcactccttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40528 - DNA, 280 bp, Artificial
  Mutation in BnaC.FAD2.b introduced by TALE nuclease pair BnFAD2_T03
caggatccatgggtgcagggggaagaatgcaagtctctcctccctccagtctctccacctcactgcttcaaacgctccatcccacgctccttctcctcttcgacatcatcatctcctcctcggctcctccctctaccacctctccacagcctacttccctctcctcccccaccctctcccttacctcgcctggcccctctacttggcctgccaaggctgcgtcctaacgggcctctgggtcatagcccacgagtgcggccaccacgccttcagcgactac

SEQ ID NO: 40529 - DNA, 338 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40530 - DNA, 408 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacttcgctgctacccaaggttgccccacgagtacatcgagctgatcgagatcgcccggaacagcacccaagagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40531 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccaccagtgcggccaccacgccttcagcgactac

SEQ ID NO: 40532 - DNA, 337 bp, Artificial
  Mutation in BnaC.FAD2.b introduced by TALE nuclease pair BnFAD2_T03
caggatccatgggtgcaggtggaagaatgcaagtctcacctccctccagctcccccgaaaccaaaaccctcaaacgcgtcccctgcgagacaccacccttcactcttagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccgcgaatgcggccaccacgccttcagcgactac

SEQ ID NO: 40533 - DNA, 350 bp, Artificial
  Mutation in BnaC.FAD2.b introduced by TALE nuclease pair BnFAD2_T03
caggatccatgggtgcaggtggaagaatgcaagtctctcctccctcccgctcccccgaaaccaaaaccctcaaacgcgtcccctgcgagacaccacccttcactcccgaccccaagaaagcaatcccaccacactgcttcaaacgctccatccctccctccttctcctccccccccttcgacatcctcgtccccccctccctctcccacctctccccagcctacttccctctcctcccccaccctctcccttacctcgcctgacccctctactgggccggccaaggctgcgtcctaacgggcctctgggtcatagcccacgagtgcggccaccacgccttcagcgactac

SEQ ID NO: 40534 - DNA, 403 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagatcggcgatatcgatgctgtccatgtgctgtctctcgaacttggcagcggcagtctccttatcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40535 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaacgggcctctgggtcatagcccacgagtgcggccaccacgccttcagcgactac

SEQ ID NO: 40536 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtcttaaaccgacaccatcaagcgcgtaccctgcgagacaccgcccttcactgtagaactcaagaaagcaatcccaccgcactgtttcaaacgctcgatccctcgctctttctcctacctcctcttcgacatcctcgtctcctcctccatctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 40537 - DNA, 346 bp, Artificial
  Mutation in BnaC.FAD2.b introduced by TALE nuclease pair BnFAD2_T03
caggatccatgggtgcaggtcgaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtcctaaccggcctctgggtcatagcccacgagtgcggccaccacgccttcagcgactac

SEQ ID NO: 40538 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctccctttcctcgcctgacccctctactgggccggccaaggctgcgtccgaacgggcctctgggtcatagcccacgagtgcggccaccacgccttcagcgactac

SEQ ID NO: 40539 - DNA, 327 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccaccctgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggatgcgtcctaacgggcctctgggtcatagcccacgagtgcggccaccacgccttcagcgactac

SEQ ID NO: 40540 - DNA, 328 bp, Artificial
  Mutation in BnaC.FAD2.b introduced by TALE nuclease pair BnFAD2_T03
caggatccatgggtgcaggtggaagaatgcaagtctctcctccctccagctccaccgaaaccaaaaccctcaaacgcgtcccctgcgagacaccacccttcactctagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40541 - DNA, 332 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccaccatcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgaatgcggccaccacgccatcagcgactac

SEQ ID NO: 40542 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 40543 - DNA, 295 bp, Artificial
  Mutation in BnaC.FAD2.b introduced by TALE nuclease pair BnFAD2_T03
caggatccatgggtgcaggtggaagaatgcaagtctcacctccctccagctcccccgaaaccaaaaccctccacctcactgcttcaaacgctccatccctcgctccttctcctacctcctcttctacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 40544 - DNA, 335 bp, Artificial
  Mutation in BnaC.FAD2.b introduced by TALE nuclease pair BnFAD2_T03
caggatccatgggtgcaggtggaagaatgcaagtctctcctccataccgctcccccggaaccaacaccctcaaacgcgtcccctgcgagacaccaccattcacttagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgcgcctgccaaggctgcgtcctaacgggcctctgggtcatagcccacgagtgcggccaccacgccttcagcgactac

SEQ ID NO: 40545 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccatgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 40546 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactacctcaagaaagcaatcccacctcactgcttcaaacgctccatcccacgctccttatcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40547 - DNA, 275 bp, Artificial
  Mutation in BnaC.FAD2.b introduced by TALE nuclease pair BnFAD2_T03
caggatccatgggtgcaggtggaagaatgcaagtctctagacctcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40548 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40549 - DNA, 347 bp, Artificial
  Mutation in BnaC.FAD2.b introduced by TALE nuclease pair BnFAD2_T03
caggatccatgggggcaggtggaagaatgcaagtctctcctccctccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcctcggctcctcctccctctaccacctctccacagcctacttccctctcctcccccaccctctcccttacctcgcctggcccctctactgggcctgccaaggctgcgtcctaacgggcctctgggtcatcgcccccgaatgcggccaccacgccttcagcgactac

SEQ ID NO: 40550 - DNA, 351 bp, Artificial
  Mutation in BnaC.FAD2.b introduced by TALE nuclease pair BnFAD2_T03
caggatccatgggtgcaggtgcaagaatgcaagtctctcctccctccagctcccccggaaccaacaccctcaaacgcgtcccctgcgagacaccacccttcactcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40551 - DNA, 442 bp, Artificial
  Mutation in BnaC.FAD2.b introduced by TALE nuclease pair BnFAD2_T03
caggatccatgggtgcaggtggaagaatgcaagtctctcctccctcccgctcccccgaaaccaaaaccctcaaacgcgtcccctgcgagacaccacccttcactctcagagattttgagacacgggccagagctgccaggaaacagctgtgaccatgtaatacgactcactataggggatgggatccgatgaagacaatcgacagagacctcaagaaagcaatcccacctcactgcttcaaacgccccatcccacgctccttctccccttcgacatcatcatcgcctcctccctctaccacccctccacagcctacttccctctcctcccccaccctctcccttacctcgcctggcccctctactgggcctgccaaggctgcgtcctaacgggcctctgggtcatcgcccacgaatgcggccaccacgccgtcagcgactac

SEQ ID NO: 40552 - DNA, 317 bp, Artificial
  Mutation in BnaC.FAD2.b introduced by TALE nuclease pair BnFAD2_T03
caggatccatgggtgcaggtggaagaatgcatgtctctcctccctccagctccgcggaaaccaaaaccctcaaacgcgtcccctgcgagacaccacccttcactctcggcttcaccgcttcaaacgctccatcccaccctcctgcgcctcgtcgacatcagcatctcctccccggctcctccctctaccacctctccacagcctacttccctctcccttacctcgcctgacccctctactgggcctgccagggctgcgtcctaacgggcctctgggtcatagcccaccagtgcggccaccacgccatcagcgactac

SEQ ID NO: 40553 - DNA, 335 bp, Artificial
  Mutation in BnaC.FAD2.b introduced by TALE nuclease pair BnFAD2_T03
caggatccatgtgtgcaggtggaagaatgcaagtctatcctccctcccgctcccccgaaaccaaaaccctcaaacgcgtcccctccgagacaccacccttcactgagacctcaagaaagcaatcccacctcactgcttcaaacgctccatcccacgctccttctcctcttcgccatcatcatctcctcctcggctcctccctctaccacctctccacagcctacttccctctcccttacctcgcctgacccctctactgggccggccaaggctgcgtcctagcgggcctctgggtcatagctcacgagtgcggcgaccacgccttcagcgactac

SEQ ID NO: 40554 - DNA, 348 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 40555 - DNA, 339 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagaaagcaatcccaccgcactgtttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40556 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40557 - DNA, 398 bp, Artificial
  Mutation in BnaC.FAD2.b introduced by TALE nuclease pair BnFAD2_T03
caggatccatgggtgcagggggaagaatgcaagtctctcctccctccagctcccccgaaaacaaaaccatcaagcgcgtaccctgcgagacaccgccctttacgtgaaccatcgccctgatagacggtttttcgccctttgacgttggagtccacgttctttaatagtggaactcaagaaagcaatcccacctcactgcttcaaacgcgccatcccacgctccttctcctcttcgacatcatcatctcctcctcggctcctccctctaccacctctccacagcctacttccctctcccttacctcgcctaacccctctaccgggcctgccaaggctgcgtcctaacgggcctcggggtcatcgcccacgagtgcggccaccacgccatcagcgactac

SEQ ID NO: 40558 - DNA, 334 bp, Artificial
  Mutation in BnaC.FAD2.b introduced by TALE nuclease pair BnFAD2_T03
caggatccatgggtgcaggtggaagaatgcaagtgtctcctccctcccagaagtctgaaaccgacaccatcaagcgcgtcccctgcgagacaccaccatttcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgcgcctgccaagcctgcgtcctaacgggcctctgggtcatagcccacgagtgcggccaccacgccctcagcgactaa

SEQ ID NO: 40559 - DNA, 345 bp, Artificial
  Mutation in BnaC.FAD2.b introduced by TALE nuclease pair BnFAD2_T03
caggatccatgggtgcaggtggaagaatgcaagtctctcatccctacagctcccccggaaacaacaccctcaaacgagtcccctgcgagacaccaccattcactcttacagcgagcgatcccacctcactgcttcaaacgctccatcccacgctccttctcctacctcctcttcgacatcctcgtctcctcctccctctaccacctctccacagcctacttccctctcctcccccaccctctcccttacctcgcctgacccctctactgggcctgccaaggctgcgtcctaacggtcctctggggcatagcccacgagtgctgccaccacgccatcatcgactac

SEQ ID NO: 40560 - DNA, 413 bp, Artificial
  Mutation in BnaC.FAD2.b introduced by TALE nuclease pair BnFAD2_T03
caggatccatgggtgcaggtggaagaatgcaagtccctcctccctccagctcccccgaaaccaaaaccctcaaacgcgtcccctgcgagacaccacccttcactcttggggggtcaagccgtgggcctggtacagcaccggcaacagccgctggaccgtccccagcgcctgcttgagacctccagaaagcaatcccacctccccgcttcaaccgctccatccctcgctccttctcccccctcctcttcgacatcctcgtctcctcctcggcccctccctctaccacctccccacagcctccttccctctcccttacctcgcctgccccctctactgggcctgccaaggctgcgtcctaacgggcctctgggtcatagcccacgattgcggccaccacgccttcatcgactacc

SEQ ID NO: 40561 - DNA, 336 bp, Artificial
  Mutation in BnaC.FAD2.b introduced by TALE nuclease pair BnFAD2_T03
caggatccatgggtgcaggtgcaagaatgcaagtctctcctccctccagctcccccggaaccaacaccctcaaacgcgtcccctgcgagacaccaccattcacctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgagcctgccaaggctgcgtcctaacgggcctctgggtcatagcccacgagtgcggccaccacgccttcagcgactac

SEQ ID NO: 40562 - DNA, 349 bp, Artificial
  Mutation in BnaC.FAD2.b introduced by TALE nuclease pair BnFAD2_T03
caggatccatgggtgcaggtagaagaatgcaagtctctcctccctccagctcccccgaaaccaaaaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgcgcctgccaaggctgcgtcctaacgggcctctgggtcatcgcccacgaatgcggccaccacgccttcagcgactac

SEQ ID NO: 40563 - DNA, 302 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctctgagacctcaagaaagcaatcccacctcactgcttcaaacgctccatccctcgctccttctcctacctcctcttcgacatcatcatctcctcctcggctcctccctcaccctctctcctacttcgcctggcctctctactgggcctgccaaggctgcgtcctaacgggcctctgggtcatagcccacgagtgtggccaccacgccttcagcgactac

SEQ ID NO: 40564 - DNA, 347 bp, Artificial
  Mutation in BnaC.FAD2.b introduced by TALE nuclease pair BnFAD2_T03
caggatccatgggtgcaggtggaagaatgcaagtgtatccaccctccagctcccccgaaaccaaaaccctcaaacgagtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctcccaaggctgcgtcctaacgggcctctgggtcatcgcccaccaatgcgtccaccacgcctttagcgactac

SEQ ID NO: 40565 - DNA, 335 bp, Artificial
  Mutation in BnaC.FAD2.b introduced by TALE nuclease pair BnFAD2_T03
caggatccatgggtgcaggtggaagaatgcaagtctctcctccctccagctccctcggaaccaacaccctcaaccgcgtcccctccgagacaccacccttcactctgacctcaagaaagcaatcccacctcactgcttcaaacgctccatccctcgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 40566 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaacaacaccctcaaacgcgtcccctgcgagacaccaccattcactagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccatcagcgactac

SEQ ID NO: 40567 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40568 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctagcgggcctctgggtcatagcccacgagtgcggccaccacgccttcagcgactac

SEQ ID NO: 40569 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacaggcccacggcttgaccccccagcaggtggtggccatcgccagcaataatgggggcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcagcgcccacgaatgcggccaccacgccttcagcgactac

SEQ ID NO: 40570 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctacctcctcttcgacatcctcgtctcctcctccctctaccacctctccacagcctacttccctctcctcccccaccctctctcctacttcgcctggcctctctactgggcctgccagggctgcgtcctaaccggcctctgggtcatagcccacgagtgcggccaccacgccttcagcgactac

SEQ ID NO: 40571 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 40572 - DNA, 333 bp, Artificial
  Mutation in BnaC.FAD2.b introduced by TALE nuclease pair BnFAD2_T03
caggatccatgggtgcaggtggaagaatgcaagtgtctcctccatccaagaagtctgaaaccgacaccatcaagcgcgtaccctgcgagacaccgcccttcactgaacccaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctctgggtcatagcccacgagtgcggccaccacgccttcagcgactac

SEQ ID NO: 40573 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgtagagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 40574 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggactgccaaggctgcgtcctaacgggcctctgggtcatagcccacgagtgcggccaccacgccttcagcgactac

SEQ ID NO: 40575 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaacccacaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40576 - DNA, 334 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctacgagacaccgcccttcactgaaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40577 - DNA, 343 bp, Artificial
  Mutation in BnaC.FAD2.b introduced by TALE nuclease pair BnFAD2_T03
caggatccatgggtgcaggtggaagaatgcaagtctctcatccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 40578 - DNA, 351 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40579 - DNA, 371 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggaagagtttgtagaaacgcaaaaaggccatccgtcagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgctgccaccacgccttcagcgactac

SEQ ID NO: 40580 - DNA, 345 bp, Artificial
  Mutation in BnaC.FAD2.b introduced by TALE nuclease pair BnFAD2_T03
caggatccatgggtgcaggtagaagaatgcaagtctctcctccatccagctcccccgaaaccaaaaccctcaaacgcgtcccctgcgagacaccacccttgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40581 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcggccacgaatgcggccaccacgccttcagcgactac

SEQ ID NO: 40582 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacccccaaacgcgtcccctgcgagacaccaccattcactcaggacctcaagaaagcaatcccacctcactgcttcaaacgctccatccctcgctccttctcctacctcctcttcgacatcctcgtctcctcctccctctaccaccgctccacagcctacttccctctcctccctcaccctctctcctacttcgcccggcctctctactgggcctgccaagggtgcgtcctaaccggcgtctgggtcatagcccacgagtgcggccaccacgccatcagcgactac

SEQ ID NO: 40583 - DNA, 348 bp, Artificial
  Mutation in BnaC.FAD2.b introduced by TALE nuclease pair BnFAD2_T03
caggatccatgggtgcaggtggaagaatgcaagtgtctcctccatccaagaagactgaaaccgacaccatcaagcgcgtaccctgcgagacaccgcccttcactgtaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcccggcccctctactgggcctgccaaggctgcgtcctaacgggcctctgggtcatcgcccacgaatgcggccaccacgccttcagcgactac

SEQ ID NO: 40584 - DNA, 336 bp, Artificial
  Mutation in BnaC.FAD2.b introduced by TALE nuclease pair BnFAD2_T03
caggatccattggtgcaggtggaagaatgcaagtctctcctccctccagctcccccggaaccaacaccctcaaacgcgtcccctgctagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 40585 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgtgcctgccaaggctgcgtcctaacgggcctctgggtcatagcccacgagtgcggccaccacgccttcagcgactac

SEQ ID NO: 40586 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtcggggtcattgcccacgagtgcggccaccacgccttcagcgactac

SEQ ID NO: 40587 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccatgagtgcggccaccacgccttcagcgactac

SEQ ID NO: 40588 - DNA, 276 bp, Artificial
  Mutation in BnaC.FAD2.b introduced by TALE nuclease pair BnFAD2_T03
caggatccatgggtgcaggtggaagaatgcaagtctctcctctcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagtgactac

SEQ ID NO: 40589 - DNA, 331 bp, Artificial
  Mutation in BnaC.FAD2.b introduced by TALE nuclease pair BnFAD2_T03
caggatccatgggtgcaggtggaagaatgcaagtctctcctccccccagctcccccgaaaccaaaaccctcaaccgcgtcccctgcgagacctcaagaaagcaatcccacctcactgcttcaaacgctccatccctcgctccttctcctccctcctcttcgacatcctcgtctcctcctccctctaccacctctccacagcctacttccctctcctcccccaccctctcccttccctcgcctggcccctctactgggcctgccagggctgcgtcctaaccggcgtctgggtcatagcccacgagtgcggccaccacgccatcagcgactac

SEQ ID NO: 40590 - DNA, 413 bp, Artificial
  Mutation in BnaC.FAD2.b introduced by TALE nuclease pair BnFAD2_T03
caggatccatgggtgcaggtggaagaatgcaagtctttcctcccccccgctcccccggaaccaacaccctcaaacgcgtcccctgcgagacaccaccattccgctggaccgtctccagcgcctgcttgccaccgccattgctggcgatggccaccacctgctggggagtcaagccgtgggcctagacctcaagaaagcaatcccacctcactgcttcaaacgctccatcccacgctccttctcctcttcgacatcatcatctcctcctcggctcctccctctcccccctctccccagcctgcttccctctcccttacctcgccaggcccctctactgggccggccaagactgcgtcctaacgggcctctgggtcatcgccctcgaatgcggccaccacgccatcagcgactac

SEQ ID NO: 40591 - DNA, 309 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgcactgtttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40592 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtcggagacctcaagaaagcaatcccacctcactgcttcacaccctccatcccaccctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgaatgcggccaccacgccttcagcgactac

SEQ ID NO: 40593 - DNA, 317 bp, Artificial
  Mutation in BnaC.FAD2.b introduced by TALE nuclease pair BnFAD2_T03
caggatccatgggtgcaggcgcaagaatgcaagtctctcctccatccagctcccccggaaccaacaccctcaaacgcgtcccttgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcagagcccacgagtgcggccaccacgccttcagcgactac

SEQ ID NO: 40594 - DNA, 318 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctttcagcgactac

SEQ ID NO: 40595 - DNA, 348 bp, Artificial
  Mutation in BnaC.FAD2.b introduced by TALE nuclease pair BnFAD2_T03
caggatccatgggtgcaggtcgaagaatgcaagtctctcctccatccagctcccccggaaccaacaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40596 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccctcaagaaagcaatcccacctcactgcttcaaacgctccatccctcgctccttctcctcttcgacatcctcgtctcctcctccctctaccacctctccacagcctacttccctctcccttacctcgcctgacccctctactgggcctaccaaggctgcgtcctaacgggcctctgggtcatcgcccacgaatgcggccaccacgccttcagcgactac

SEQ ID NO: 40597 - DNA, 336 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40598 - DNA, 335 bp, Artificial
  Mutation in BnaC.FAD2.b introduced by TALE nuclease pair BnFAD2_T03
caggatccatgggtgcaggtgcaagaatgcaagtgtctcctccctccaaaaagtctgaaaccgacaacatccagcgcgtaccctgcgagacaccgcccttcactgtgaactcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggccggccaaggctgcgtcctaacgggcctctgggtcatagcccacgagtgcggccaccacgccttcagcgactac

SEQ ID NO: 40599 - DNA, 350 bp, Artificial
  Mutation in BnaC.FAD2.b introduced by TALE nuclease pair BnFAD2_T03
caggatccatgggtgcaggtggaagaatgcaagtctctcctccatccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40600 - DNA, 349 bp, Artificial
  Mutation in BnaC.FAD2.b introduced by TALE nuclease pair BnFAD2_T03
caggatccatgggtgcaggtggaagaatgcaagtgtctcctccctccagcacccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40601 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttgacctcaagaaagcaatcccacctcactgcttcaaacgctccatcccacgctccttcacctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40602 - DNA, 358 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaccgcgtcccctgcgagacaccaccattcactctcggtcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccgcgaatgcggccaccacgccttcagcgactac

SEQ ID NO: 40603 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctacatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40604 - DNA, 362 bp, Artificial
  Mutation in BnaC.FAD2.b introduced by TALE nuclease pair BnFAD2_T03
caggatccatgggtgcaggtggaagaatgcaagtctctcacccctccagctcccccggaaccaacaccctcaaacgcgtcccctgcgagacaccaccattcactcaatggcggtggcaagcaggcgctggagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40605 - DNA, 336 bp, Artificial
  Mutation in BnaC.FAD2.b introduced by TALE nuclease pair BnFAD2_T03
caggatccatgggtgcaggtggaagaatgcaagtctcacctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40606 - DNA, 444 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcactctctccgatttagtgctttacggggaaagccggcgaacgtggcgagaaaggaagggaagaaagcgaaaggagcgggcgctagggcgctggcaagtgtagcggttacgcgcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40607 - DNA, 306 bp, Artificial
  Mutation in BnaC.FAD2.b introduced by TALE nuclease pair BnFAD2_T03
caggatccatgggtgcaggtggaagaatgcaagtctctcctccctcccgctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcccctggcccctctactgtgcctgccaaggctgtgtcctaacgggcctcttggtcatagcccacgagtgcggccaccacgccatcagcgactac

SEQ ID NO: 40608 - DNA, 462 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtccgtgggcctggcacagcaccggcaacagccgctggaccgtctccataacgcggcctttttacggttcctggccttttgctggccttttgctcacatgttctttcctgcgttatcccccgggagacctcaagaaagcaatcccccctcactgcttcaaacgctccatcccacgctccttctcctcttcgacatcatcatctcctcctcggctcctccctctaccacctctccacagcctccttccctctcccttacctcgcctgacccctctactgggcctgccaaggctgcgtcctaacgggcctctgggtcatcgcccacgaatgcggccaccacgccttcagcgactac

SEQ ID NO: 40609 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctaactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40610 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 40611 - DNA, 344 bp, Artificial
  Mutation in BnaC.FAD2.b introduced by TALE nuclease pair BnFAD2_T03
caggatccatgggtgcaggtgaaagaatccaagtctctcctccctccagctcccccggaaccaacaccctcaaacgcgtcccctgcgagacaccaccattcactctcgggtcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40612 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctaccgggcctgccaagggtgcgtcctaaccggcgtctgggtcatagcccacgagtgcggccaccacgccttcagcgactac

SEQ ID NO: 40613 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctaacccctctactgggcctgccaaggctgcgtcctaaccggcgtctgggtcatagcccacgagtgcggccaccacgccttcagcgactac

SEQ ID NO: 40614 - DNA, 394 bp, Artificial
  Mutation in BnaC.FAD2.b introduced by TALE nuclease pair BnFAD2_T03
caggatccatgggtgcaggtcgaagaatgcaagtctctcctccctccagctcccccggaaccaacaccctcaaacgcgtcccctgcgagacaccaccattcactcttgtccaccacctgctccggggtcaagctggaggggtacaccttccaccactcgttgggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40615 - DNA, 333 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcacagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40616 - DNA, 349 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40617 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactcggcctgccaaggctgcgtcctaacgggcctctgggtcatagcccacgattgcggccaccacgccttcagcgactac

SEQ ID NO: 40618 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40619 - DNA, 346 bp, Artificial
  Mutation in BnaC.FAD2.b introduced by TALE nuclease pair BnFAD2_T03
caggatccatgggtgcagggggaagaatgcaagtctctcctccctccagctcccccggaaccaacaccatcaaacgcgtcccctacgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggtccctctactgggccggccaaggctgcgtcctaactggcctctgggtcatcgcccacgaatgctgccaccacgccatcagcgactac

SEQ ID NO: 40620 - DNA, 329 bp, Artificial
  Mutation in BnaC.FAD2.b introduced by TALE nuclease pair BnFAD2_T03
caggatccatgggtgcaggtgcaagaatgcaagtctctcctccctccagctcccccggaaccaacaccctcaaacgcgtcccctgcgagacaccaccattcaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgacta

SEQ ID NO: 40621 - DNA, 306 bp, Artificial
  Mutation in BnaC.FAD2.b introduced by TALE nuclease pair BnFAD2_T03
caggatccatgggtgcaggtacaagaatgcaagtctctcctccatcccgctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40622 - DNA, 347 bp, Artificial
  Mutation in BnaC.FAD2.b introduced by TALE nuclease pair BnFAD2_T03
caggatccatgggtgcaggtggaagaatgcaagtctctcctccctccagctccaccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 40623 - DNA, 320 bp, Artificial
  Mutation in BnaC.FAD2.b introduced by TALE nuclease pair BnFAD2_T03
caggatccatgggtgcaggtggaagaatgcaagtgtctcctccctccaagaagcctgaaaccgacaccatcaagcgcgtaccctgcgagacaccaccattcactctatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcccaacgggcctctgggtcatagcccacgagtgcggccaccacgccatcagcgactac

SEQ ID NO: 40624 - DNA, 347 bp, Artificial
  Mutation in BnaC.FAD2.b introduced by TALE nuclease pair BnFAD2_T03
caggatccatgggtgcaggtcgaagaatgcaagtctctcctccctccagctcccccgaaaccaaaaccctcaaacgcgtcccctgcgagacaccacccctcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatggcccacgagtgcggccaccacgccttcagcgactac

SEQ ID NO: 40625 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcccccctctaccacctctccacagcctacttccctctcctgccccaccctctcccttacctcgcctgacccctctactgggcctgccaaggctgcgtcctaacgggcctctgggtcatagcccacgagtgcggccaccacgccttcagcgactac

SEQ ID NO: 40626 - DNA, 345 bp, Artificial
  Mutation in BnaC.FAD2.b introduced by TALE nuclease pair BnFAD2_T03
caggatccatgggtgcaggtggaagaatgcaagtctctcctccctacagctcccccgaaaccaaaaccatcaaacgcgaccctgcgagacaccacccttcaagacctcaagaaagcaatcccacctcactgcttcaaacgctccatccctcgctccttctcctacctcctcttcgacatcctcgtctcctcctccctctaccacctctccacagcctacttccctctcctcccccaccctctaccttacctcgcctggcccctctactgggcctgccaaggctgcgtcctaacgggcctctgggtcatcgcccacgaatgcggccaccacgccttcagcgactac

SEQ ID NO: 40627 - DNA, 343 bp, Artificial
  Mutation in BnaC.FAD2.b introduced by TALE nuclease pair BnFAD2_T03
caggatccatgggtgcaggtggaagaatgcaagtctctcatccctccagctcccccgaaaccaaaaccctcaaacgcgtcccctgcgagacaccacccttcactctagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgcgcctgccaaggctgcgtcctaacgggcctctgggtcatctcccacgaatgcggccaccacgccatcagcgactac

SEQ ID NO: 40628 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcacctcaagaaagcaatcccacctcactgcttcaaacgctccatcccacgctccttctcctcttcgacatcatcatctcctcctcggctcctccctctaccacctctccacagcctacttccctctcccatacctcgcctgacccctctactgggcctgccaaggctgcgtcctaacgggcctctgggtcatcgcccacgaatgcggccaccacgccttcagcgactac

SEQ ID NO: 40629 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 40630 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtcggggtcatagcccacgagtgcggccaccacgccgtcagcgactac

SEQ ID NO: 40631 - DNA, 337 bp, Artificial
  Mutation in BnaC.FAD2.b introduced by TALE nuclease pair BnFAD2_T03
caggatccatgggtgcaggtggaagaatgcaagtctctcccccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40632 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagacctcaagaaagcaatcccacctcactgcttcaaacgccccatcccacgccccttctcctcttcgacatcatcctctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40633 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgtgtcctaacgggcctctgggtcatcgcccacgaatgcggccaccacgccttcagcgactac

SEQ ID NO: 40634 - DNA, 305 bp, Artificial
  Mutation in BnaC.FAD2.b introduced by TALE nuclease pair BnFAD2_T03
caggatccatgggtgcaggtggaagaatgcaagtctcccctccatccagctcccccggaaccaacaccctcaaacgcgtcccctgcgagacaccaccattcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 40635 - DNA, 335 bp, Artificial
  Mutation in BnaC.FAD2.b introduced by TALE nuclease pair BnFAD2_T03
caggatccatgggtgcaggtggaagaatgcaagtctctcctccctccagctccaccggaaccaacaccatcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctcgcccttacctcgcctgacccctctcctgggcgtgcctaggctgcgtcctaacgggcctcgtgggcagatcccacgagtgcggccaccgcgccatcagcgactac

SEQ ID NO: 40636 - DNA, 334 bp, Artificial
  Mutation in BnaC.FAD2.b introduced by TALE nuclease pair BnFAD2_T03
caggatccatgggtgcagggggaagaatgcaagtctctcctccctccagctcccccggaaccaacaccctcaaacgcgtcccctgcgagacaccaccattcactctccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40637 - DNA, 346 bp, Artificial
  Mutation in BnaC.FAD2.b introduced by TALE nuclease pair BnFAD2_T03
caggatccatgggtgcaggtggaagaatgcaagtctctcctccctccagctccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40638 - DNA, 337 bp, Artificial
  Mutation in BnaC.FAD2.b introduced by TALE nuclease pair BnFAD2_T03
caggatccatgggtgcaggtgaaagaatgcaagtctcacctccctccagctcccccggaaccaacacactcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccgtcagcgactac

SEQ ID NO: 40639 - DNA, 323 bp, Artificial
  Mutation in BnaC.FAD2.b introduced by TALE nuclease pair BnFAD2_T03
caggatccatgggtgcaggtggaagaatgcaagtctctcctccatccagctcccccgaaaccaaaaccctcaaacgcgtcccctgcgagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40640 - DNA, 336 bp, Artificial
  Mutation in BnaC.FAD2.b introduced by TALE nuclease pair BnFAD2_T03
caggatccatgggtgcaggtggaagaatgcaagtctctcatccctccagctcccccgaaaccaaaaccctcaaacacgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40641 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctacaagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 40642 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcaggcgctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40643 - DNA, 308 bp, Artificial
  Mutation in BnaC.FAD2.b introduced by TALE nuclease pair BnFAD2_T03
caggatccatgggtgcaggtggaagaatgcaagtctctcatccctccagctcccccgaaaccaaaaccctcaaacgcgtcccctgcgagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40644 - DNA, 328 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40645 - DNA, 354 bp, Artificial
  Mutation in BnaC.FAD2.b introduced by TALE nuclease pair BnFAD2_T03
caggatccatgggtgcaggtggaagaatgcaagtctctcctccctcccgctcccccgaaaccaaaaccctcaaacgcgtcccctgcgagacaccacccttcactctcgggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgcgcctgccaaggctgcgtcctaacgggcctctgggtcatagcccacgagtgcggccaccacgccttcagcgactac

SEQ ID NO: 40646 - DNA, 440 bp, Artificial
  Mutation in BnaC.FAD2.b introduced by TALE nuclease pair BnFAD2_T03
caggatccatgggtgcaggtgcaagaatgcaagtctctcctccctccagctcccccggaaccaacaccctcaaacgcgtcccctgcgagacaccaccattcactcaggctccgcccccctgacgagcatcacaaaaatcgacgctcaagtcagaggtggcgaaacccgacaggactataaagataccaggcgtgtccccctcaagaaagcaatcccacctcactgcttcaaacgctccatcccacgctccttccccccttcgacatcatcatctcctcctcggctcctccctctaccacctctccacagcctacttccctctcctcccccaccccctcccttccctcgcctggcccctctactgggcctgccaaggctgcgtcctaacgggcctctgggtcatagcccacgagtgcggccaccacgccttcagcgactac

SEQ ID NO: 40647 - DNA, 310 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgtcactgtttcaaacgctccatccctcgctccttctcctacctcctcttcgacatcctcgtctcctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 40648 - DNA, 343 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcactctcggtcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgattgcggccaccacgccttcagcgactaa

SEQ ID NO: 40649 - DNA, 337 bp, Artificial
  Mutation in BnaC.FAD2.b introduced by TALE nuclease pair BnFAD2_T03
caggatccatgggtgcaggtggaagaatgcaagtctctcctccctccagctccaccgaaaccaaaaccctcaaacgcgtcccctgcgagacagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 40650 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 40651 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40652 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgcctggcccctctactgcgcctgccagggctgcgtcctaacgggcctctgggtcatcgcccacgaatgcggccaccacgccttcagcgactac

SEQ ID NO: 40653 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaactcctccctcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40654 - DNA, 331 bp, Artificial
  Mutation in BnaC.FAD2.b introduced by TALE nuclease pair BnFAD2_T03
caggatccatgggtgcaggtggaagaatgcaagtctctcctgcctccagctccaccggaaccaacaccctcaaacgcgtcccctgcgagacaccaccattcacaccacaagaaagcaatcccacctcactgcttcaaacgctccatcccacgctccttctcctcttcgacatcatcatctcctcctcggctcctccctctaccacctctccacagcctacttccctctcccttacctcccctgacccctctactgggcctgccaaggctgcgtcctaacgggcctctgggtcatagcccacgagtgcggccaccacgccatcagcgactac

SEQ ID NO: 40655 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40656 - DNA, 278 bp, Artificial
  Mutation in BnaC.FAD2.b introduced by TALE nuclease pair BnFAD2_T03
caggatccatgggtgcaggtggaagaatgcaagtctctcctccatccagctcccccgaaaccaaaaccctcaaacgcgtcccctgcgagacaccacccttcactctcgacatcctcgtctcctcctccctctaccacctctccacagcctacttccctctcctccccccccctctcccttacctcgcctggcccctctactgggcctgccaagggtgcgtcctaaccggcgtctgggtcatagcccacgagtgcggccaccacgccttcagcgactac

SEQ ID NO: 40657 - DNA, 333 bp, Artificial
  Mutation in BnaC.FAD2.b introduced by TALE nuclease pair BnFAD2_T03
caggatccatgggtgcaggtggaagaatgcaagtctctcctccctccagctccaccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40658 - DNA, 333 bp, Artificial
  Mutation in BnaC.FAD2.b introduced by TALE nuclease pair BnFAD2_T03
caggatccatgggtgcaggtggaagaatgcaagtgtctccaccccccaagaagcctgaaaccgacaccatcaaacgcgtcccctgcgagacaccgcccttcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40659 - DNA, 411 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtggcaagcagacgctggagacggtccagcggctgttgccggtgctgtgccaggcccacggcttgaccccggaagacctcaagaaagcaatcccacctcactgcttcaaacgctccatcccacgctccttcccctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40660 - DNA, 305 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40661 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctggttcatagcccacgagtgcggccaccacgccttcagcgactac

SEQ ID NO: 40662 - DNA, 404 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgcaattaatacgcgtaccgctagacaggaagagtttgtagaaacgcaaaacggagacctcaagaaagcaatcccacctcactgcttcaaacgctccatccctcgctccttctcctacctcctcttcgacatcctcgtctcctcctccctctaccacctcgccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40663 - DNA, 336 bp, Artificial
  Mutation in BnaC.FAD2.b introduced by TALE nuclease pair BnFAD2_T03
caggatccatgggtgcaggtgcaagaatgcaagtctctcctccctccagctcccccggaaccaacaccctcaaacgcgtcccctgcgagacaccaccattcactctagacctcaagaaagcaatcccacctcactgcttcaaacgccccatcccaccctccttctcctcttcgacatcatcatctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 40664 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40665 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcaagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctagccggcgtctgggtcatagcccacgagtgcggccaccacgccatcagcgactac

SEQ ID NO: 40666 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40667 - DNA, 257 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacacctccattcactctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40668 - DNA, 346 bp, Artificial
  Mutation in BnaC.FAD2.b introduced by TALE nuclease pair BnFAD2_T03
caggatccatgggtgcaggtagaagaatgcaagtgtatccttcatacaaaaagtctgaaaccgacaacatcaagcgcgtaccctgcgagacaccgcccttcacgaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40669 - DNA, 300 bp, Artificial
  Mutation in BnaC.FAD2.b introduced by TALE nuclease pair BnFAD2_T03
caggatccatgggtgcaggtggaagaatgcaagtctctcctccatccagctcccccgaaaccaaagaaaacaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccatcagcgactac

SEQ ID NO: 40670 - DNA, 349 bp, Artificial
  Mutation in BnaC.FAD2.b introduced by TALE nuclease pair BnFAD2_T03
caggatccatgggtgcaggtgaaagaatgcaagtctctcctccctccagctcccccggaaccaacaccatcaaacgcgtcccctgcgagacaccaccattcactctagacctcaagaaagcaatcccaccgcactgtttcaaacgctcgatcccacgctccttctcctacctcctcttcgacatcctcgtctcctcctccctctaccacctctccacagcctacttccctctcctcccccaccctctcccttaccccgccgggcccctctacggggcctgccaaggctgcggcctaacgggcctcggggtcatcgcccactaaggcgtgcaccacgccttcagcgacta

SEQ ID NO: 40671 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccatcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40672 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40673 - DNA, 305 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactgcttcaaacgctccatcccacgctccttctcctcttcgacatcatcatctcctcctcggctcctccctctaccacctctccacagcctccttccctctcccttacctcgcctgacccctctactgggcctgccaaggctgcgtcctaacgggcctctgggtcatagcccaagagtgcggccaccacgccttcagcgactac

SEQ ID NO: 40674 - DNA, 291 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40675 - DNA, 349 bp, Artificial
  Mutation in BnaC.FAD2.b introduced by TALE nuclease pair BnFAD2_T03
caggatccatgggtgcaggtggaagaatgcaagtctctcctccctccagcccccccgaaaccaaaaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40676 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccatcaaacgcgtcccctgcgagacaccaccattcactcgagacctcaacaaagcaatcccacctcactgcttcaaactctccatcccaccctccttctcctcttcgacatcatcatctcctcctctgcccctccctctcccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 40677 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagaccccaccattcactctgagacctcaagaaagcaatcccacctcactgcttcaaacgctccatccctcgctccttctcctacctcctcttcgacatcctcgtctcctcctccctctaccacctctccacagcctacttccctctcccccccaccctctcccttacctcgcctggcccctctactgggcctgccaaggctgcgtcctaacgggcctctgggtcatcgcccacgaatgcggccaccacgccttcagcgactac

SEQ ID NO: 40678 - DNA, 458 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaccgcgtcccctgcgagacaccacccttcaccaccacctgctccggggtcaagccgtgggcctggcacagcaccggcaaacgttggcgtcggcaaacagtggtccggcgcacgcgctctggaggccttgctcacggtggcgggagagttgagagggagacctcaagaaagcaatcccacctcactgctccaaacgctccatccctcgctcctgctccccttcgacatcatcaccccctcctcggctcctccctctaccacctctccacagcctacttccctctcccttacctcgcctgacccctctactgggcctgccaaggctgcgtcctaacgggcctcggggtcagagcccacgagtgcggccaccgcgccttcagcgactac

SEQ ID NO: 40679 - DNA, 346 bp, Artificial
  Mutation in BnaC.FAD2.b introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40680 - DNA, 336 bp, Artificial
  Mutation in BnaC.FAD2.b introduced by TALE nuclease pair BnFAD2_T03
caggatccatgggtgcagggggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 40681 - DNA, 350 bp, Artificial
  Mutation in BnaC.FAD2.b introduced by TALE nuclease pair BnFAD2_T03
caggatccatgggtgcaggtggaagaatgcaagtctctcctcccccccgctcccccggaaccaacaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcatcgactac

SEQ ID NO: 40682 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaactcctccctcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40683 - DNA, 335 bp, Artificial
  Mutation in BnaC.FAD2.b introduced by TALE nuclease pair BnFAD2_T03
caggatccatgggtgcaggtagaagaatgcaagtctctcctccctcccgctcccccgaaaccaaaaccctcaaacgcgtcccctgtgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaactggcctctgggtcagagcccacgagtgcggccaccacgccttcagcgactac

SEQ ID NO: 40684 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctctgggtcattgcccacgagtgcggccaccacgccttcagcgactac

SEQ ID NO: 40685 - DNA, 330 bp, Artificial
  Mutation in BnaC.FAD2.b introduced by TALE nuclease pair BnFAD2_T03
caggatccatgggtgcaggtggaagaattcaagtgtctcctacccaccgctcccccggaaccaacaccctcaaacgcctcccctgcgagacaccaccaagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcgcgcgagtgcggccaccacgccttcatcgactac

SEQ ID NO: 40686 - DNA, 327 bp, Artificial
  Mutation in BnaC.FAD2.b introduced by TALE nuclease pair BnFAD2_T03
caggatccatgggtgcaggtggaagaatgcaagtctctcctgcctcccgctccaccgaaaccaaaaccctcaaacgcgtcccctacgagacaccacccttcactcaagaaagcaatcccacctcactgcttcaaacgctccatccatctctccttctcctacctcctcttcgacatcctcgtctcctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 40687 - DNA, 351 bp, Artificial
  Mutation in BnaC.FAD2.b introduced by TALE nuclease pair BnFAD2_T03
caggatccatgggtgcaggtggaagaatgcaagtctctcctccctccagctccaccgaacccaaaaccctcaaacccgtcccctgcgagacaccacccttcactcttagacctcaagaactcaatcccacctcactgcttcaaacgctccatccctccctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgctgccaccacgccttcagcgactac

SEQ ID NO: 40688 - DNA, 326 bp, Artificial
  Mutation in BnaC.FAD2.b introduced by TALE nuclease pair BnFAD2_T03
caggatccatgggtgcaggtccaagaatgcaagtctcccctccacccagctcccccggaaccaacaccctcacacccgtcccctaccagccgctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtccgaacgggcctctggttcatagccctcgagtgcggccaccacgccatctgcgactac

SEQ ID NO: 40689 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 40690 - DNA, 322 bp, Artificial
  Mutation in BnaC.FAD2.b introduced by TALE nuclease pair BnFAD2_T03
caggatccatgggtgcaggtggaagaatgcaagtctctcctgcctacagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctaacccctctactgggcctgccaaggctgcgtcctaacgggcctcttggtcatatcccacgagtgcggccaccacgccatcagcgactac

SEQ ID NO: 40691 - DNA, 350 bp, Artificial
  Mutation in BnaC.FAD2.b introduced by TALE nuclease pair BnFAD2_T03
caggatccatgggtgcaggtggaagaattcaagtgtttcattcctccaagaagtctgaaaccgacaccatcaagcgcgtacccagcgagacaccgcccttcactgtagaactcaagaaagcaatcccaccgcactgcttcaaacgctccatccctcgctccttctcctacctcctcttcgacatcctcgtctcctcctccctctaccacctctccacagcctacttccctctcctccctcaccctctccctttcctcgcctggcccctctactgggccggccaagactgcgtcctaacgggcctctgggtcatcgcccgcgaatgctgcgaccacgccatcagcgactac

SEQ ID NO: 40692 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcagacctcaagaaagcaatcccacctcactgcttcaaacgctccatccctcgctccttctcctacctcgtcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40693 - DNA, 336 bp, Artificial
  Mutation in BnaC.FAD2.b introduced by TALE nuclease pair BnFAD2_T03
caggatccatgggtgcaggtgaaagaatgcaagtctcacctccctacagctcccccggaaccaacaccctcaaacgcgtcccctacgagacaccaccattcactctagccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctagcgggcctctgggtcatatcctacgagtgcggccaccacgccatcatctactac

SEQ ID NO: 40694 - DNA, 257 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcctcggctcctccctctaccacctctccacagcctacttccctctcccttacctcgcctgacccctctactgggcctgccagggctgcgtcctaaccggcgtctgggtcatagcccacgagtgcggccaccacgccatcagcgactac

SEQ ID NO: 40695 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctagcctctctactgggcctgccaagggtgcgtcctaaccggcgtctgggtcatagcccacgagtgcggccaccacgccttcagcgactac

SEQ ID NO: 40696 - DNA, 295 bp, Artificial
  Mutation in BnaC.FAD2.b introduced by TALE nuclease pair BnFAD2_T03
caggatccatgggtgcaggtggaagaatgcaagtctctcctccccccagctcccccgaaaccaaaaccctccacctcactgcttcaaacgctccatccctcgctccttctcctacctcctcttcgacatcctcgtctcctcctccctctaccacctctcaacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 40697 - DNA, 336 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccaccattcactcaggacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgcgcctgccaaggctgcgtcctaacgggcctcggggtcatagcccacgagtgcggccaccacgccttcagcgactac

SEQ ID NO: 40698 - DNA, 345 bp, Artificial
  Mutation in BnaC.FAD2.b introduced by TALE nuclease pair BnFAD2_T03
caggatccatgggtgcaggtgcaagaatgcaagtctctcctccatccagctcccccgaaaccaaaaccctcaaacgcgtcccctgcgagacaccaccattcagacctcaagaaagcaatcccacctcactgcttcaaacgctccatccctcgctccttctcatacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40699 - DNA, 331 bp, Artificial
  Mutation in BnaC.FAD2.b introduced by TALE nuclease pair BnFAD2_T03
caggatccatgggtgcaggtggaagaatgcaagtctctccccccaccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcggggtcatcgcccacgaatgcggccaccacgccttcagcgactac

SEQ ID NO: 40700 - DNA, 351 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40701 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaacacgccttcagcgactacc

SEQ ID NO: 40702 - DNA, 417 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattaactctcggcggttgccggggctttgccaggcccacggcttgaccccggagcagggggtggccatccccagccacgatggcggcaagagacctcaagaaagcaatcccacctcactgcttcaaacgctccatcccacgctccttctcctcttcgacatcatcacctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 40703 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggtcaccacgccttcagcgactac

SEQ ID NO: 40704 - DNA, 354 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtccggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40705 - DNA, 324 bp, Artificial
  Mutation in BnaC.FAD2.b introduced by TALE nuclease pair BnFAD2_T03
caggatccatgggtgcaggcggaagaatgcaagtctctcctccctccagctcccccggacccaacaccctcaaacgcgtcccctgcgagacctcaagaaagcaattccacctcactgcttcaaacgctccatcccacgctccttctcctcttcgacatcctcgtctcctcctccctctaccacctctccacagcctacttccctctcctcccccaccctctcccttacctcgcctggcccatctactgggcctgccaaggctgcgtcctaacgggcctctgggtcatcgcccacgaatgcggccaccacgccttcagcgactac

SEQ ID NO: 40706 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccaggccttcagcgactac

SEQ ID NO: 40707 - DNA, 327 bp, Artificial
  Mutation in BnaC.FAD2.b introduced by TALE nuclease pair BnFAD2_T03
caggatccatgggtgcaggtgcaagaatgcaagtctctcctccatccagctcccccgaaaccaaaaccctccaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40708 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgtcaaggctgcgtcctaacgggcctctgggtcatagcccacgagtgcggccaccacgccttcagcgactac

SEQ ID NO: 40709 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcttggtcatagcccacgagtgcggccaccacgccttcagcgactac

SEQ ID NO: 40710 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgtagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccatcagcgactac

SEQ ID NO: 40711 - DNA, 350 bp, Artificial
  Mutation in BnaC.FAD2.b introduced by TALE nuclease pair BnFAD2_T03
caggatccatgggtgcaggtggaagaatgcaagtctcccctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40712 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 40713 - DNA, 348 bp, Artificial
  Mutation in BnaC.FAD2.b introduced by TALE nuclease pair BnFAD2_T03
caggatccatgggtgcaggtggaagaatgcaagtctctcatccctccagctcccccggaaccaacaccctcaaacgcgtcccctgcgagacaccaccattcactagacctcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40714 - DNA, 349 bp, Artificial
  Mutation in BnaC.FAD2.b introduced by TALE nuclease pair BnFAD2_T03
caggatccatgggtgcaggtggaagaatgcaagtctcacatccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40715 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40716 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 40717 - DNA, 336 bp, Artificial
  Mutation in BnaC.FAD2.b introduced by TALE nuclease pair BnFAD2_T03
caggatccatgggtgcaggtccaagaatgcaagtctctcctccatccagctcccccgaacccaaaaccctcaaacgcgtcccctgcgagacaccacccttcactctcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacggcttcagcgactac

SEQ ID NO: 40718 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccaccgcactgtttcaaacgctcgatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 40719 - DNA, 337 bp, Artificial
  Mutation in BnaC.FAD2.b introduced by TALE nuclease pair BnFAD2_T03
caggatccatgggtgcaggtggaagaatgcaagtctctcctccctcccgctcccccgaaaccaaaaccctcaaacgcgtcccctgcgagacaccacccttcactctagaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40720 - DNA, 322 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaactcaagaaagcaatcccaccgcactgtttcaaacgctccatcccacgctccttctcctcttcgacatcatcatctcctcctcggctcctccctctaccacctctccacagcctacttccctctcccttacctcgcctaacccctctactgggcctgccaaggctgcgtcctaacgggcctctgggtcatagcccacgagtgcggccaccacgccttcagcgactac

SEQ ID NO: 40721 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctggagacctcaagaaagcaatcccacctcactgcttcaaacgctccatcccacgctccttctccccttcgacatcatcatctcctcctcggctcctccctctaccacctctccacagcctacttccctctcccttgcctcgcctgacccctctactgggcctgccaaggctgcgtcctaacgggcctctgggtcatcgcccacgagtgcggccaccacgccttcagcgactac

SEQ ID NO: 40722 - DNA, 337 bp, Artificial
  Mutation in BnaC.FAD2.b introduced by TALE nuclease pair BnFAD2_T03
caggatccatgggtgcaggtggaagaatgcaagtctctcctccctccagctccaccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctaccgggcctgccaaggctgcgtcctaacgggcctctgggtcatcgcccacgaatgcggccaccacgccttcagcgactac

SEQ ID NO: 40723 - DNA, 332 bp, Artificial
  Mutation in BnaC.FAD2.b introduced by TALE nuclease pair BnFAD2_T03
caggatccatgggtgcaggtggaagaatgcaagtgtctcctccatccaagaagtctgaaaccgacaccatcaagcgcgtaccctgcgagacaccgcccttcactgaactcaagaaagcaatcccacctcactgcttcaaacgctccatccctcgctccttctcctacctcctcttcaacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40724 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 40725 - DNA, 374 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttttgccagcgcctaatgcgccgggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 40726 - DNA, 316 bp, Artificial
  Mutation in BnaC.FAD2.b introduced by TALE nuclease pair BnFAD2_T03
caggatccatgggtgcaggtgaaagaatgcaagtctctcatccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 40727 - DNA, 346 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaactcaagaaagcaatcccacctcactgcttcaaacgctccatccctcgctccttctcctacctcctcttcgacatcctcgtctcctcctccctctaccacctctccacagcctactttcctctcctcccccaccctctcccttacctcgcctggcccctctactgggcctgccaaggctgcgtcctaaccggcgtctgggtcatagcccacgagtgcggccaccacgccttcagcgactac

SEQ ID NO: 40728 - DNA, 403 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttaggtacctcgcgaatgcatctagatccaatgatcatgagcggagaattaaggagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40729 - DNA, 346 bp, Artificial
  Mutation in BnaC.FAD2.b introduced by TALE nuclease pair BnFAD2_T03
caggatccatgggtgcaggggaaagaatgcaagtctatcctccctccagctcccccgaaaccaaaaccatcaaacgcgtcccctgcgagacaccacccttcactacctcaagaaagcaaccccacctcactgcttcaaacgctccatccctccctccttctcctacctcatcttcaacatcctcgtctcctcctccctctaccacctctccacagcctacttccctctcctcccccacccgctcccttacctcgcctagcccctctactgggcctgccaaggctgcgtccgaacgggcctctgggtcatctcccacaaatgcggcctccacgccatcagcgactac

SEQ ID NO: 40730 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcatcatctcctcctcggctcctccctctaccacctctccacagcctacttccctctcccttacctagcctggcccctctactgggcctgccaaggctgcgtcctaacgggcctctgggtcatcgcccacgaatgcggccaccacgccttcagcgactac

SEQ ID NO: 40731 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcatgacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagttcggccaccacgccttcagcgactac

SEQ ID NO: 40732 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 40733 - DNA, 334 bp, Artificial
  Mutation in BnaC.FAD2.b introduced by TALE nuclease pair BnFAD2_T03
caggatccatgggtgcaggaggaagaatgcaagtctctcctccctccagctcccccgaaaccaaaaccctcaaacgcgtcccctgcgagacaccacccttcactctacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40734 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccatcagcgactac

SEQ ID NO: 40735 - DNA, 323 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacacctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaacgggcctctgggtcatagcccacgagtgcggccaccacgccttcagcgactac

SEQ ID NO: 40736 - DNA, 354 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40737 - DNA, 347 bp, Artificial
  Mutation in BnaC.FAD2.b introduced by TALE nuclease pair BnFAD2_T03
caggatccatgggtgcaggtggaagaatgcaagtgtctcctgcctccaagaagtctgaaaccgacaccatcaagcgcgtaccctgcgagacaccgcccttcacttaactcaagaaagcaatcccacctcactgcttcaaacgctccatccctcgctccttctcctacctcctcttcgacatcctcgtctcctcctccctctaccacctctccacagcctacttccctctcctccccccccctctcccttacctcgcctggcccctctactgcgcctgccaaggctgcgtcctaacgggcctctgggtcatcgcccacgaatgcggccaccacgccttcagcgactac

SEQ ID NO: 40738 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 40739 - DNA, 330 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccaacaccctcaaacgcgtcccctgcgagacaccaccattcaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctggggcatagcccacgagtgcggccaccacgccttcagcgactac

SEQ ID NO: 40740 - DNA, 376 bp, Artificial
  Mutation in BnaC.FAD2.b introduced by TALE nuclease pair BnFAD2_T03
caggatccatgggtgcaggtggaagaatgcaagtctgtcctccctccagctcccccggaaccaaaaccctcaaacgtgtcccctgcgagacaccacccttcactctgctgcgtaacatcgttgctgctccagagacctcaagaaagcaatcccacctcactgcttcaaacgctccatccctcgctcctcctcctacctcctcttcgacatcctcgtctcctcctccctctccccccgctccacagcctacttccctcccctcccccacccgctcccttacctcgcctagcccctctcctgggcctgccaaggctgcgtcctaacgggcctctgggtcatcgcccacgaatgctgccaccacgccttcagcgactac

SEQ ID NO: 40741 - DNA, 290 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgaactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40742 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtccgaacgggcctctgggtcatcgcccacgaatgcggccaccacgccttcagcgactac

SEQ ID NO: 40743 - DNA, 332 bp, Artificial
  Mutation in BnaC.FAD2.b introduced by TALE nuclease pair BnFAD2_T03
caggatccatgggtgcaggtggaagaatgcaagtctctcctccctccagctccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40744 - DNA, 314 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcagcgactac

SEQ ID NO: 40745 - DNA, 314 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccacctcactgcttcaaacgctccatccctcgctccttctcctacctcctcttcgacatcctcctctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40746 - DNA, 329 bp, Artificial
  Mutation in BnaC.FAD2.b introduced by TALE nuclease pair BnFAD2_T03
caggatccatgggcgcaggtggaagaatgcaagtctctcctccctccagctcccccggaaccaacaccctcaaacgcgtcccctgcgagacaccaccatgctccttaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40747 - DNA, 452 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctggcgatggccaccacctgctccggggtcaagccgtgggcctggcacagcaccggcaacagccgctggaccgtctccagcgcctgcttgccaccattattgctggcgatgaaagacctcaagaaagcaatcccacctcactgcttcaaacgctccaccccacgctcctcctcctcttcgacaccatcatctcctcctcggctcctccctctcccccctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40748 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcacacgcgtcccctgcgagacaccacccttcactctcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40749 - DNA, 305 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40750 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccatctactgggcctgccaaggctgcgtcctaacgggcctctgggtcatagcccacgagtgcggccaccacgccttcagcgactac

SEQ ID NO: 40751 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctattgggcctgccaaggctgcgtcctaacgggcctctgggtcatcgcccacgaatgcggccaccacgccttcagcgactac

SEQ ID NO: 40752 - DNA, 335 bp, Artificial
  Mutation in BnaC.FAD2.b introduced by TALE nuclease pair BnFAD2_T03
caggatccatgggtgcaggtgaaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40753 - DNA, 335 bp, Artificial
  Mutation in BnaC.FAD2.b introduced by TALE nuclease pair BnFAD2_T03
taggatccatgggtgcaggtggaagaatgcaagtctctcctccctccagctccccaggacccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40754 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaaccggcgtcttggtcatagcccacgagtgcggccaccacgccttcagcgactac

SEQ ID NO: 40755 - DNA, 332 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaccgcgtcccctgcgagacaccaccattcacttcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcttcggggtcatagcccacgagtgcggccaccacgccttcatcgactac

SEQ ID NO: 40756 - DNA, 336 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccaccattcactctagacctcaagaaaacaatcccacctccctgcttcaaacgctccatcccaccctccttctcctcttcgacatcatcatctcctcctcggcgcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40757 - DNA, 311 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacaagaaagcaatcccacctcactgcttcaaacgctccatcccacgctccttctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40758 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccacctcactgcttcaaacgctccatcccacgctccttctcctcttcgacatcatcatctcctcctcggctcctccctctaccacctctccacagcctacttccctctcccttacctcgcctgacacctctactgggcctgccaaggctgcgtcctaacgggcctctgggtcatagcccacgagtgcggccaccacgccttcagcgactac

SEQ ID NO: 40759 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatagcccacgagtgcggccaccacgccttcagcgactac

SEQ ID NO: 40760 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcgggacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 40761 - DNA, 337 bp, Artificial
  Mutation in BnaC.FAD2.b introduced by TALE nuclease pair BnFAD2_T03
caggatccatgggtgcaggtgaaagaatgcaagtgtctcctccctccaaaaagtctgaaaccgacaacatcaagcgcgtaccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctcaactgggcctgccaaggctgcgtcctaacgggcctctgggtcatagcccacgagtgcggccaccacgccttcagcgactac

SEQ ID NO: 40762 - DNA, 324 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccaccattcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40763 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40764 - DNA, 335 bp, Artificial
  Mutation in BnaC.FAD2.b introduced by TALE nuclease pair BnFAD2_T03
caggatccatgggtgcaggtggaagaatgcaagtgactcctccctccaaaaagtctgaaaccgacaacatcaagcgcgtaccctgcgagacaccgcccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40765 - DNA, 336 bp, Artificial
  Mutation in BnaC.FAD2.b introduced by TALE nuclease pair BnFAD2_T03
caggatccatgggtgcaggtcgaagaatgcaagtctctcctccctccagctcccccgaaaccaaaaccctcaaacgcgtcccctgcgagacaccacccttcactctccatcccacctcactgcttcaaacgctccatccctcgctccttctcctacctcctcttctacctcctcgtctcctcctccctcttccacctctccacaccctacttccctcccctccccctccctctcccttacctcgcctggcccctctactgggcctgccaaggctgcgtcctaacgggcctctgggtcatcgcccacgaatgcggccaccacgccttcagcgactac

SEQ ID NO: 40766 - DNA, 342 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccaccctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40767 - DNA, 280 bp, Artificial
  Mutation in BnaC.FAD2.b introduced by TALE nuclease pair BnFAD2_T03
caggatccatgggtgcaggtggaagaatgcaagtctcgacctcaagaaagcaatcccacctcactgcttcaaacgctccatccctcgctccttctcctacctcctcttcggcatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40768 - DNA, 317 bp, Artificial
  Mutation in BnaC.FAD2.b introduced by TALE nuclease pair BnFAD2_T03
caggatccatgggtgcaggtggaagaatgcaagtctctcctccctccagctccaccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40769 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40770 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctcaatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40771 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 40772 - DNA, 332 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40773 - DNA, 357 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctccgccggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacttggcctgccaaggctgcgtcctaacgggcctctgggtcatcgcccacgaatgcggccaccacgccttcagcgactac

SEQ ID NO: 40774 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctctctgcttcaaacgctccatcccaccccccttctcctcttccacctcaccatctcctcctcggctcctccctctcccacctctccccaccctccttccctctcccttacctcgcctgacccctctactgggcctgccaaggctgcgtcctaacgggcctctgggtcatagcccacgagtgcggccaccacgccttcagcgactac

SEQ ID NO: 40775 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40776 - DNA, 278 bp, Artificial
  Mutation in BnaC.FAD2.b introduced by TALE nuclease pair BnFAD2_T03
caggatccatgggtgcagggggaagaatgcaagtctctcctccctccagctcccccgaaaccaaaaccctcaaacgcgtcccctgcgagacaccacccttcactctcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 40777 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggcgcctccctctaccacctctccacagcctacttccctctcccttacctcgcctgacccctctaccgggcctgccaaggctgcgtcctaacgggcctctgggtcaacgcccacgaatgcggccaccacgccttcagcgactac

SEQ ID NO: 40778 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggcgaccacgccttcagcgactac

SEQ ID NO: 40779 - DNA, 344 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 40780 - DNA, 347 bp, Artificial
  Mutation in BnaC.FAD2.b introduced by TALE nuclease pair BnFAD2_T03
caggatccatgggtgcaggtgcaagaatgcaagtctctcctccctccagctcccccgaacccaaaaccctcaaacgcgtcccctgcgagccaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctagcccctctactgagcctgccaaggctgcgtcctaacgggcctctgggtcatagcccacgagtgcggccaccacgccttcagcgactac

SEQ ID NO: 40781 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcactac

SEQ ID NO: 40782 - DNA, 334 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgtgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 40783 - DNA, 335 bp, Artificial
  Mutation in BnaC.FAD2.b introduced by TALE nuclease pair BnFAD2_T03
caggatccatgggtgcaggtggaagaatgcaagtctctcctgcatccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 40784 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctccctcaccctctctcctactgcgcctggcctctctacggggcctgccagggctgcgtcctaaccggcgtctgggtcatagcccacgagtgcggccaccacgcctcagcgactac

SEQ ID NO: 40785 - DNA, 341 bp, Artificial
  Mutation in BnaC.FAD2.b introduced by TALE nuclease pair BnFAD2_T03
caggatccatgggtgcaggtgaaagaatgcaagtgtctcccccctccaaaaagtctgaaaccgacaacatcaagcgcgtaccctgcgagacaccaccattcactctcgggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcaagcgactac

SEQ ID NO: 40786 - DNA, 335 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40787 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgaccccaagaaagcaatcccacctcactgcttcaaacgctccatcccacgctccttctcctcttcgacatcatcatctcctcctcggctcctccctctaccacctctccacagcctacttccctctcccttgcctcgcctgacccctctactgggcctgccaaggctgcgtcctaacgggcctctgggtcatagcccacgagtgcggccaccacgccttcagcgactac

SEQ ID NO: 40788 - DNA, 283 bp, Artificial
  Mutation in BnaC.FAD2.b introduced by TALE nuclease pair BnFAD2_T03
caggatccatgggtgcaggtggaagaatgcaagtctctagacctcaagaaagcaatcccacctcactgcttcaaacgctccatcccacgctccttctcctcttcgacataatcatctccacctcggcccctccctctaccacctctcccccgcctacttccctctcctcccccaccctctcccttacctcgcctggcccctctactgtgcctgccaaggctgcgtcctaacgggcctctgggtcatcgcccacgaatgcggccaccacgccttcagcgactac

SEQ ID NO: 40789 - DNA, 320 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctatcccacctcactgcttcaaacgctccatcccacgctccttctcctcttcgacatcatcatctcctcctcggctcctccctctaccacctctccacagcctacttccctctcccttacctcccctgacccctctactgggcctgccaaggctgcgtcctaacgggcctctgggtcatagcccacgagtgcggccaccacgccttcagcgactac

SEQ ID NO: 40790 - DNA, 279 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttcgacatcctcgtctcctcctccctctaccacctctccacagcctacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 40791 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaccctcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40792 - DNA, 352 bp, Artificial
  Mutation in BnaC.FAD2.b introduced by TALE nuclease pair BnFAD2_T03
caggatccatgggtgcaggaggaagaatgcaagtgtcaccaccctacaagaaggctgaaaccgacaccatcaagcgcgtaccctgcgagacaccgcccttcactgcaagaactcaagaaagcaatcccaccgcactgtttcaaacgcccgatccctcgctctttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40793 - DNA, 350 bp, Artificial
  Mutation in BnaC.FAD2.b introduced by TALE nuclease pair BnFAD2_T03
caggatccatgggtgcaggtgaaagaatgcaagtgtctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcccctggcccctctactgagcctgccaaggctgcgtcctaacgggcctctgggtcatcgcccacgaatgcggccaccacgccatcagcgactac

SEQ ID NO: 40794 - DNA, 398 bp, Artificial
  Mutation in BnaC.FAD2.b introduced by TALE nuclease pair BnFAD2_T03
caggatccatgggtgcaggtggacgaatgcaagtctctcgtccctccagctcccccgaaaccaaaaccctcaaacgcgtcccctgcgagacaccacccttcactctcggctgttgccggtgctgtgccaggcccacggcttgaccccggagcagggggtggccatcggagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40795 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 40796 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagctactac

SEQ ID NO: 40797 - DNA, 257 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 40798 - DNA, 420 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactatttgatgcctggcagttccctactctcgccagcaataatggtggcaagcaggcgctggagacggtccagcggagaactcaagaaagcaatcccaccgcactgtttcaaacgctcgatccctcgctctttctcctacctcctcttcgccatcctcgtctccccctccccctcccccctctccacagcctactcccctctcctcccccaccctctcccttaccccgcctggcccctctactgggcctgccaaggctgcgtcctaacgggcctctgggtcatcgcccacgaatgcggccaccacgccttagcgactac

SEQ ID NO: 40799 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccaccgcactgtttcaaacgctcgatccctcgctctttctcctccctcatctgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40800 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40801 - DNA, 336 bp, Artificial
  Mutation in BnaC.FAD2.b introduced by TALE nuclease pair BnFAD2_T03
caggatccatgggtgcaggtgcaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcagcgcccacgaatgcggccaccacgccttcagcgactac

SEQ ID NO: 40802 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcggggtcatcgcccgcgagtgcggcgaccacgccatcagcaactac

SEQ ID NO: 40803 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttaccacgcctggcccctctactgggcctgccaaggctgcgtcctaacgggcctctgggtcatcgcccacgaatgcggccaccacgccttcagcgactac

SEQ ID NO: 40804 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccctgaaaccaacaccctcaaacgcgtcccctgcgagacaccaccattcactatacctcaagacaagaatcccacctcaccgcttcaatcgctccatcccacccccctccccctcttcgacatcatcatcccctcctccgctcctccctctaccacctcccccccgcctccttccctctcccttacctcgcctgacccctctactgggcctgccaaggctgcgtcctaacgggcctctgggtcatcgcccacgaatgcggccaccacgccttcagcgactac

SEQ ID NO: 40805 - DNA, 404 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccatcaaacgcgtcccctgcgagacaccacccttcactctcggcggatttgtcctactcaggagagcgttcaccgacaaacaacagataaaacgaaaggctcagtctttgacctcaagaaagcaatcccacctcactgcttcaaacgctccatcccacgctccttctcctcttcgacatcatcatcccctcctcggctcctccctctcccacctccccacagcctacttccctctcccttacctcgcctgacccctctcctgggcctgccaaggctgcgtcctaacgggcctctgggtcatagcccacgagtgctgccaccacgccttcagcgactac

SEQ ID NO: 40806 - DNA, 329 bp, Artificial
  Mutation in BnaC.FAD2.b introduced by TALE nuclease pair BnFAD2_T03
caggatccatgggtgcaggtggaagaatgcaagtctctccttcctccagctcccccggaaccaacaccctcaaacgcgtcccctgcgagaccccatggcggacctcaagaaagcaatcccaccttactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaaccggcgtctgggtcatagcccacgagtgcggccaccacgccttcagcgactac

SEQ ID NO: 40807 - DNA, 333 bp, Artificial
  Mutation in BnaC.FAD2.b introduced by TALE nuclease pair BnFAD2_T03
caggatccatgggtgcaggtggaagaatgcaagtctctcatccctccagctcccccggaaccaacaccctcaaacgcgtcccctgcgagacaccaccattcactctcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40808 - DNA, 349 bp, Artificial
  Mutation in BnaC.FAD2.b introduced by TALE nuclease pair BnFAD2_T03
caggatccatgtgtgcaggtggaagaatgcatgtctctcctccctccagctcccccgaaaccaaaaccctcaaacgcgtcccctgcgagacaccacccttcactctgacctcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgccggacccctctactgggcctgccaaggctgcgtcctaacgggcctctgggtcatagcccacgagtgcggccaccacgccttcagcgactac

SEQ ID NO: 40809 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcatgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40810 - DNA, 333 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40811 - DNA, 358 bp, Artificial
  Mutation in BnaC.FAD2.b introduced by TALE nuclease pair BnFAD2_T03
caggatccatgggtgcaggtggaagaatgcaagtctctcctccctcccgctcccccgaaaccaaaaccctcaaacgcgtcccctgcgagacaccacccttcactctcggatcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctcctgggcctgccaaggctgcgtcctaacgggcctctgggtcatagcccacgagtgcggccaccacgccttcagcgactac

SEQ ID NO: 40812 - DNA, 329 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtcccctgcgagacaccaccatagcctttctagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40813 - DNA, 335 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccaccattcacttagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtgctagcgggcctcggggtgatggcgcgcgagtgcggcggccaggccttgagcgactac

SEQ ID NO: 40814 - DNA, 279 bp, Artificial
  Mutation in BnaC.FAD2.b introduced by TALE nuclease pair BnFAD2_T03
caggatccatgggtgcaggtggaagaatgcaagtctttcctccctccagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 40815 - DNA, 309 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40816 - DNA, 400 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctggcaacgctgcgatcatgtcctgatccttgacagcgacggtccctatcgcagacctcaagaaagcaatcccacctcactgcttcaaacgctccatccctcgctccttctcctacctcctcttcgacatcctcgtctcctcctccctctaccacctctccacagcctacttccctctccgcccccacccgctcccttacctcgcctggcccctctactgggcctgccaaggctgcgtcctaacgggcctctgggacatcgcccacgaatgcggccaccacgccatcagcgactac

SEQ ID NO: 40817 - DNA, 333 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacacccccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40818 - DNA, 327 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccacctcactgcttcaaacgctccatccctcgctccttctcctacctcctcttcgacatcctcgtctcctcctccctctaccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 40819 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40820 - DNA, 333 bp, Artificial
  Mutation in BnaC.FAD2.b introduced by TALE nuclease pair BnFAD2_T03
caggatccatgggtgcaggtggaagaatgcaagtgtcacctccctccaagaagtctgaaaccgacaccatcaagcgcgtaccctgcgagacaccacccttcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactaggcctgccaaggctgcttcctaacgggcctctgggtcatagcccacaagtgctgccaccacgccttcagcgactac

SEQ ID NO: 40821 - DNA, 353 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 40822 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggcccccacgccttcagcgactac

SEQ ID NO: 40823 - DNA, 300 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 40824 - DNA, 347 bp, Artificial
  Mutation in BnaC.FAD2.b introduced by TALE nuclease pair BnFAD2_T03
caggatccatgggtgcaggtcgaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacttggcctgccaaggctgcgtcctaacgggcctctgggtcatcgcccacgaatgcggcctccacgccttcatcgactac

SEQ ID NO: 40825 - DNA, 334 bp, Artificial
  Mutation in BnaC.FAD2.b introduced by TALE nuclease pair BnFAD2_T03
caggatccatgggtgcaggtggaagaatgcaagtctctcctccctccaagaagcctgaaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacggcctacttccctctcccttacctcgcctgacccctctactgggcctgccaaggctgcttcctaacgggcctctgggtcatagcccgcgaatgcggcctccacgccttcagcgactac

SEQ ID NO: 40826 - DNA, 408 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttggccaccacctgctgaggggtcaagccgtgggcctgtcacagcaccggcaacagccgctggaggagacctcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 40827 - DNA, 336 bp, Artificial
  Mutation in BnaC.FAD2.b introduced by TALE nuclease pair BnFAD2_T03
caggatccatgggtgcaggtcgaagaatgcaagtgtctcctccctccaagaagtctgaaaccgacaccatcaagcgcgtaccctgcgagacaccgccattcactcaagacctcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40828 - DNA, 302 bp, Artificial
  Mutation in BnaC.FAD2.b introduced by TALE nuclease pair BnFAD2_T03
caggatccatgggtgcaggtggaagaatgcaagtgtcacctccctccaagaaggctgaaaccgacaccatcaagaactcaagaaagcaatcccaccgcactgtttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 40829 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40830 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcactgaactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40831 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctccccctccctctcccttacctcgcctggcccctctactgggcctgccaaggctgcgtcctaacgggcctctgggtcatcgcccacgaatgcggccaccacgccttcagcgactac

SEQ ID NO: 40832 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacactaccattcactcagacctcaagaaagcaatcccacctcactgcttcaaacgccccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40833 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaaccggcctctgggtcatagcccacgagtgcggccaccacgccttcagcgactac

SEQ ID NO: 40834 - DNA, 324 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40835 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccatcccacgctccttctcaagaaagcaatcccacctcactgcttcaaacgctccatcccacgctccttctcctcttcgacatcatcatctcctcctcggctcctccctctaccacctctccacagcctacttccctctcccttccctcgcctgccccctctactgggcctgccaaggctgcgtcctaacgggcctctgggtcatagcccacgagtgcggccaccacgccttcagcgactac

SEQ ID NO: 40836 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcctctgggtcatagcccacgagtgcggccaccacgccttcagcgactac

SEQ ID NO: 40837 - DNA, 358 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgtgagacaccgcccttcactgtctgggcggagaactcaagaaagcaatcccacctcactgcttcaaacgctccatccctcgctccttctcctacctcctcttcgacatcctcgtctcctcctccctctaccacctctccacaccctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40838 - DNA, 279 bp, Artificial
  Mutation in BnaC.FAD2.b introduced by TALE nuclease pair BnFAD2_T03
caggatccatgggtgcaggtggaagaatgcaagtctctcctccctacagctcccccgaaaccaaaaccctcaaacgcgtcccctgcgagacaccacccttcactcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40839 - DNA, 331 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40840 - DNA, 333 bp, Artificial
  Mutation in BnaC.FAD2.b introduced by TALE nuclease pair BnFAD2_T03
caggatccattggtgcaggtggaagaatgcaagtctctcctccctccagctcccccggaaccaacaccctcaaacgcgtcccctgcgagacaccaccattcactaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40841 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 40842 - DNA, 313 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttccccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40843 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcttacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40844 - DNA, 283 bp, Artificial
  Mutation in BnaC.FAD2.b introduced by TALE nuclease pair BnFAD2_T03
caggatccatgggtgcaggtggaagaatgcaagtgtctcctccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtaatcgcccacgaatgcggccaccacgccttcagcgactac

SEQ ID NO: 40845 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 40846 - DNA, 371 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcgggggtggggggtacgtagaccccaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40847 - DNA, 348 bp, Artificial
  Mutation in BnaC.FAD2.b introduced by TALE nuclease pair BnFAD2_T03
caggatccatgggtgcaggtggaagaatgcaagtctctcctccctccagctccccgaaacccaaaccctcaaacgcgtcccctgcgagacaccacccttcactaagacctcaagaaagcaatcccacctcactgcttcaaacgctccatccctcgctccttctcctacctcctcttcgacatcctcgtctcctcctccctctaccacctctccacagcctacttccctcccctcccccaccctctcccttacctcgcctggcccctctactgggcctgccaaggctgcgtcctaacgggcctctgggtcatcgcccacgaatgcggccaccacgccttcagcgactac

SEQ ID NO: 40848 - DNA, 276 bp, Artificial
  Mutation in BnaC.FAD2.b introduced by TALE nuclease pair BnFAD2_T03
caggatccatgggtgcaggtggaagaatgcaagtctctcctctcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 40849 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcgggggagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40850 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 40851 - DNA, 368 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaacaccatcaacatcgtggctggcgatggccaccacctgtgccaggcccacctcaagaaagcaatcccacctcactgcttcaaacgctccatcccacgctccttctcctcttcgacatcatcatctcctcctcggctcctccctctaccacctctccacagcctacttccctctcccttccctcgcctgacccctctactgggcctgccaaggctgcgtcctaacgggcctctgggtcatcgcccacgaatgcggccaccacgccttcagcgactac

SEQ ID NO: 40852 - DNA, 349 bp, Artificial
  Mutation in BnaC.FAD2.b introduced by TALE nuclease pair BnFAD2_T03
caggatccatgggtgcatgtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 40853 - DNA, 363 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctgcgatggcggcaagcaggcgctggagaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40854 - DNA, 414 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaggccgccattgctggagatggccaccacctgctgaggggtcaagccgtgggcctggcacagcaccggcaacagccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40855 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccatcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40856 - DNA, 394 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcactcttggccaccacctgctccggggtcaagctggaggggtacaccttccaccactcgttgggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40857 - DNA, 345 bp, Artificial
  Mutation in BnaC.FAD2.b introduced by TALE nuclease pair BnFAD2_T03
caggatccatgggtgcaggtggaagaatgcaagtgtctcatccctccaagaagtctgaaaccgacaccatcaagcgcgtaccctgcgagacaccgcccttcagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40858 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 40859 - DNA, 336 bp, Artificial
  Mutation in BnaC.FAD2.b introduced by TALE nuclease pair BnFAD2_T03
caggatccatgggtgcaggtggaagaatgcaagtctctcctacctccagctcccccggaaccaacaccctcaaacgcgtcccctgcgagacaccaccattcactcgagacctcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggccggccaagggtgcgtcctaaccggcgtctgggtcatagcccacgagtgcggccaccacgccttcagcgactac

SEQ ID NO: 40860 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40861 - DNA, 434 bp, Artificial
  Mutation in BnaC.FAD2.b introduced by TALE nuclease pair BnFAD2_T03
caggatccatgggtgcaggtggaagaatgcaagcgtctcctccctccaagaagtctgaaaccgacaccatcaagcgcgtaccctgcgagacaccgcccttcactgtcggcggtggcaagcaggcgctggagacggtccagcggctgttgccggtgctgtgccaggcccacagcttgaccccccagcaggagaactcaagaaagcaatcccacctcactgcttcaaactctccatcccacgctccttctcctcttcgacatcctcatctcctcctcggctcctccctctaccccctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40862 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcgcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40863 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40864 - DNA, 307 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccatcccacgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 40865 - DNA, 331 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40866 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccagaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40867 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40868 - DNA, 279 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40869 - DNA, 344 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgacgggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40870 - DNA, 389 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagtcctgtcgggtttcgccacctctgacttgagcgtcgattgttgtgatgctccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40871 - DNA, 333 bp, Artificial
  Mutation in BnaC.FAD2.b introduced by TALE nuclease pair BnFAD2_T03
caggatccatgggtgcaggtggaagaatgcaagtctctcctccctccagctccccaggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40872 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacatcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 40873 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40874 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacctccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40875 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagcaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40876 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgtgtcctaacgggcctctgggtcatcgccaaagaatgcggccaccacgccttcagcgactaa

SEQ ID NO: 40877 - DNA, 355 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40878 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctactcccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40879 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccagagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40880 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 40881 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccatcagcgactac

SEQ ID NO: 40882 - DNA, 342 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 40883 - DNA, 342 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggcggcgtcctaaccggcgtctgggtcatagcccacgagtgcggccaccacgccttcagcgactac

SEQ ID NO: 40884 - DNA, 345 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcacccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40885 - DNA, 338 bp, Artificial
  Mutation in BnaC.FAD2.b introduced by TALE nuclease pair BnFAD2_T03
caggatccatgggtgcaggtggaagaatacaagtctctcctccctccagctcccccgaaaccaaaaccctcaaacgcgtcccctgcgagacaccacccttcaagaaagcaatcccacctcactgcttcaaacgctccatccctcgctccttctcctccctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 40886 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccaccattcactctacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 40887 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctccgcccccaccctcgcccttacctcgcctggcccctctactgggcctgccaaggctgcgtccgaacgggcctctgggtcatagcccacgagtgcggccaccacgccttcagcgactac

SEQ ID NO: 40888 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 40889 - DNA, 427 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacagcaccggcaacagccgctggaccgtctccagcgcctgcttgccaccgccaagccgtgggcctggcacagcaccggcaacagccgctggacgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40890 - DNA, 347 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40891 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40892 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagatagcaatcccacctcactgcttcaaacgctccatcccacgctccttctcctcttcgacatcatcatctcctcctcgcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40893 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatccctcgctccttctcctacctcctcttcgacatcatcatctcctcctcgactcctccctctaccacctctccacagcctacttccctctcccttacctcgcctggcccctctacggggcctgccaaggctgcgtcctaacgggcctctgggtcatcgcccacgaatgcggccaccacgccttcagcgactac

SEQ ID NO: 40894 - DNA, 349 bp, Artificial
  Mutation in BnaC.FAD2.b introduced by TALE nuclease pair BnFAD2_T03
caggacatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcaccgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40895 - DNA, 288 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40896 - DNA, 347 bp, Artificial
  Mutation in BnaC.FAD2.b introduced by TALE nuclease pair BnFAD2_T03
caggatccatgcgtgcaggtggaagaatgcaagtgtctccttccaccaaaaagtctgaaaacgacaacatcaagcgcgtaccctgcgagacaccgcccttcactgaactcaagaaagcaatcccacctcactgcttcaaacgctccatccctcgctccttctcctacctcctcttcgacatcctcgtctcctcctccctctaccacctctccacagcctacttccctcccctcccccaccctctcccttacctcgcctagcccctctactgggcctgccaaggctgcgtcctaacgggcctctgggttatatcccgcgagtgcggcctccacgccttcagcgactac

SEQ ID NO: 40897 - DNA, 350 bp, Artificial
  Mutation in BnaC.FAD2.b introduced by TALE nuclease pair BnFAD2_T03
caggatccatgggtgcaggtggaagaatgcaagtctctccaccctccagctcccccggaaccaacaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40898 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40899 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 40900 - DNA, 348 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctgacccctctcctgggcctgccaaggctgcgtcctaacgggcctctgggtcatagcccacgagtgcggccaccacgccttcagcgactac

SEQ ID NO: 40901 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40902 - DNA, 368 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgagcgccatctcgaaccgacgttgctggccgagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40903 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctccatccctcgctccttctcctacctcctcttcgacatcctcgtctcctcctccctctaccacctctccacagcctacttccctctcccttacctcgcctgacccctctactgggcctgtcaaggctgcgtcctaacgggcctctgggtcatagcccacgagtgcggccaccacgccttcagcgactac

SEQ ID NO: 40904 - DNA, 336 bp, Artificial
  Mutation in BnaC.FAD2.b introduced by TALE nuclease pair BnFAD2_T03
caggatccatgggtgcaggtggaagaatgcaagtctctcatccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40905 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctccctacctcgcctgacccctctactgggcctgccaaggctgcgtcctaacgggcctctgggtcatagcccacgagtgcggccaccacgccttcagcgactac

SEQ ID NO: 40906 - DNA, 365 bp, Artificial
  Mutation in BnaC.FAD2.b introduced by TALE nuclease pair BnFAD2_T03
caggatccatgtgtgcaggtggaagaatgcaagtgtcccacacctccaaaaagtctgaaaccgacaacatcaagcgcgtaccctgcgagacaccgcccttcactggccacgatggcggcaacagccgctggagggagacctcaagaaagcaatcccacctcactgcttcaaacgctccatcccacgctccttctcctcttcgacatcatcatctcctcctcggctcctccctctaccacctctccacagcctacttccctctcccttgcctcgcctgacccctctactgggcctgccaaggctgcgtccgaacgggcctctgggtcatagcccgcgagtgcggccaccacgccttcagcgactac

SEQ ID NO: 40907 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40908 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40909 - DNA, 296 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatcaaacgctccatcccacgctccttctcctcttcgacatcatcatctcctcctcggctcctccctctaccacctctccacagcctacttccctatcccttacctcgcctgacccctctactgggcctgccaaggctgcgtcctaacgggcctctgggtcatagcccacgagtgcggccaccacgccttcagcgactac

SEQ ID NO: 40910 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccatccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccatcagcgactac

SEQ ID NO: 40911 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctacttggcctgccaaggctgcgtcctaacgggcctctgggtcatagcccacgagtgcggccaccacgccttcagcgactac

SEQ ID NO: 40912 - DNA, 329 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccatagaactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40913 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 40914 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40915 - DNA, 397 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctggcgatggccaccaccattcactcggggggtcaagccgtgggcctggcacagcaccggcaacagccgcagacctcaagaaagcaatcccacctcactgcttcaaacgctccatcccacgctccttctcctcttcgacatcatcatctcctcctcggctcctccctctaccacctccccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40916 - DNA, 431 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggcaggtggtggccatcgccagcaatggcggtggcaagcaggcgctggagacggtccagcggctgttgccggtgctgtgccaggcccacggctagacctcaagaaagcaatcccacctcactgcttcaaacgctccatcccacgcgccttctcctcttcgacatcaccatctcctcctcggctcctccctctcccacctcgccacagcctacttccctctcccttccctcgcctgacccctctactgggcctgccaaggctgcgtcctaacgggcctctgggtcatagcccacgagtgcggccaccacgccttcagcgactac

SEQ ID NO: 40917 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40918 - DNA, 431 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggcaggtggtggccatcgccagcaatggcggtggcaagcaggcgctggagacggtccagcggctgttgccggtgctgtgccaggcccacggctagacctcaagaaagcaatcccacctcactgcttcaaacgctccatcccacgctccttctcctcgtcgacatcatcatctcctcctcggctcctccctctcccacctccccacagcctacttccctctcccttacctcgcctgccccctctactgggcctgccaaggctgcgtcctaacgggcctctgggtcatagcccacgagtgcggccaccacgccttcagcgactac

SEQ ID NO: 40919 - DNA, 431 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctgttgccggttctgtgccaggcccacggcttgaccccggagcaggtggtggccatcgccagccacgatggcggcaagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40920 - DNA, 338 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttgagaactcaagaaagcaatcccaccgcactgtttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40921 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 40922 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtctcctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 40923 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccttgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40924 - DNA, 349 bp, Artificial
  Mutation in BnaC.FAD2.b introduced by TALE nuclease pair BnFAD2_T03
caggatccatgggtgcggtggaagaatgcaagtctctcctccctccagctcccccgaaaccaaaaccctcaaacgcgtcccctgcgagacaccacccttcactggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40925 - DNA, 417 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctgttgccggtgctgtgccaggcccacggcttgaccccggagcaggtggtggccatcgccagccacgatggcggcaagagacctcaagaaagcaatcccacctcactgcttcaaacgctccatcccacgctccttctcctcttcgacatcatcatctccgcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40926 - DNA, 334 bp, Artificial
  Mutation in BnaC.FAD2.b introduced by TALE nuclease pair BnFAD2_T03
caggatccatgggtgcaggtggaagaatgcatgtctctcctccctccagctcccccggaaccaacaccctcaaacgcgtcccctgcgagacaccaccattcactctccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40927 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40928 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcatggcccctctactgggcctgccaaggctgcgtcctaacgggcctctgggtcatcgcccacgaatgcggccaccacgccttcagcgactac

SEQ ID NO: 40929 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40930 - DNA, 297 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaacgctccatcccacgctccttctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40931 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactttttcaaacgctcgatccctcgctctttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 40932 - DNA, 336 bp, Artificial
  Mutation in BnaC.FAD2.b introduced by TALE nuclease pair BnFAD2_T03
caggatccatgggtgcaggtggaagaatgcaagtctctcctcactccagctcccccgaaaccaaaaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtaatagcccacgagtgcggccaccacgccttcagcgactac

SEQ ID NO: 40933 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaaacaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40934 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccaccattcactcagacctcaagaaagcaatcccacctcactgcttcaaacgctccatcccacgctccttctcctcttcgacctcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40935 - DNA, 403 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctccagcggctgttgccgccatcgtggctggcgatggccaccacctgctccggagaactcaagaaagcaatcccaccgcactgtttcaaacgctcgatccctcgctccttctcctacctcctcttcgacatcctcgtctcctcctccctcgaccccctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40936 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgccaacgaatgcggccaccacgccttcagcgactac

SEQ ID NO: 40937 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 40938 - DNA, 456 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactctggccgctggaccgtctccagcgcctgcttgccaccgccatcgtggctggcgatggccaccacctgctccggggtcaagccgtgggcctggcacagcaccggcaagcaggcgctggagacgagacctcaagaaagcaatcccacctcactccttcaaacgccccatcccaccctccttcccctcttcgacatcatcatctcctcctcggctcctccctctaccacctccccacagcctacttccctctcccttacctcgcctgacccctctactgggcctgccaaggctgcgtcctaacgggcctctgggtcatagcccacgagtgcggccaccacgccttcagcgactac

SEQ ID NO: 40939 - DNA, 257 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcctcggctcctccctctaccacctctccacagcctacttccctctcccttacctcgcctgacccctctactgggcctgccaaggctgcgtcctaacgggcctctgggtcaaagcccacgagtgcggccaccacgccttcagcgactac

SEQ ID NO: 40940 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtaccctgcgagacaccgcccttcactaactcaagaaagcaatcccaccgcactgtttcaaacgctccatcccacgctccttctcctcttcgacatcatcatctcctcctcggctcctccctctaccacctctccacagcctacttccctctccctcacctcgcctgacccctctactggcctgcaaaggctgcgtcctaacgggcctctgggtcatagcccacgagtgcggccaccacgccttcagcgactac

SEQ ID NO: 40941 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagaccccaagaaaccaatcccacctcactgcttcaaacgctccatcccaccctccttcccctcttcgccatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 40942 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 40943 - DNA, 290 bp, Artificial
  Mutation in BnaC.FAD2.b introduced by TALE nuclease pair BnFAD2_T03
caggatccatgggtgcaggtggaagaatgcaagtctctcctctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40944 - DNA, 356 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 40945 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcatgacctcaagaaagcaatcccacctcactgcttcaaacgctccatcccacgctccttctcctcttcgacatcatcatcccctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40946 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40947 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 40948 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40949 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttcctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40950 - DNA, 341 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccaccagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40951 - DNA, 322 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 40952 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctagacctcaagaaagcaatcccacctcactgcttcaaacgctccatcccacgctccttctcctcttcgacatcatcatctcctcctcggctcctccctctaccacctctccacagcctactcccctctcccttacctcgcctgacccctctactgggcctgccaaggctgcgtcctaacgggcctctgggtcatagcccacgagtgcggccaccacgccttcagcgactac

SEQ ID NO: 40953 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacagacttcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggcggcgtcctaacgggcctctgggtcatcgcccacgaatgcggccaccacgccttcagcgactac

SEQ ID NO: 40954 - DNA, 342 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaccgagaactcaagaaagcaatcccaccgcactgtttcaaacgctcgatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40955 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattagacctcaagaaagcaatcccacctcactgcttcaaacgctccatcccaccctccttctcctcttcgacatcatcttctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40956 - DNA, 325 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 40957 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcacttgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40958 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40959 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgtccacgaatgcggccaccacgccttcagcgactgc

SEQ ID NO: 40960 - DNA, 439 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactgagcgcctgcttgccaccgccattgctggcgatggccaccacctgctccggggtcaagccgtgggcctggcacagcaccggcaacagccgctgacctcaagaaagcaatcccacctcactgcttcaaacgctccatccctcgctccttctcctacctcctcttcgacatcctcgtcgcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40961 - DNA, 319 bp, Artificial
  Mutation in BnaC.FAD2.b introduced by TALE nuclease pair BnFAD2_T03
caggatccatgtgtgcaggtggaagaatgcaagtctctcctccctccagctcccccggaaccaacaccctcaaacgcgtcccctgcgagacaccaccattcactcttgacctcaagaaagcaatcccacctcactgcttcaaacttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40962 - DNA, 294 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40963 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcctcaaacgctccatcccacgctacttctcctcttcgccttcatcatctcctcctcgactcctccccctaccacctctccacagcctacttccctctcccttacctcgcctggcccctctactgggcctgccaagggtgcgtcctaaccggcgtctgggtcatagcccacgagtgcggccaccacgccttcagcgactac

SEQ ID NO: 40964 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 40965 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcagacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40966 - DNA, 295 bp, Artificial
  Mutation in BnaC.FAD2.b introduced by TALE nuclease pair BnFAD2_T03
caggatccatgggtgcaggtggaagaatgcaagtatctcatccctccaggtagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40967 - DNA, 379 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggtcatagcattggatcggatcccgggcccgagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 40968 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 40969 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagaccccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40970 - DNA, 337 bp, Artificial
  Mutation in BnaC.FAD2.b introduced by TALE nuclease pair BnFAD2_T03
aaggatccatgggtgcaggtggaagaatgcaagtctctcctccctccagctcccccggaaccaacaccctcaaacgcgtcccctgcgagacaccaccattcactctaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 40971 - DNA, 317 bp, Artificial
  Mutation in BnaC.FAD2.b introduced by TALE nuclease pair BnFAD2_T03
caggatccatgggtgcaggtggtagaatgcaagtctctcctccctccagctcccccggaaccaacaccctcaaacgcgtcccctgccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 40972 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 40973 - DNA, 342 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtaccctgcgagacaccgcccttcactgtagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40974 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacgacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaagcctgcgtcctgacgagcctctgggtcatagcccacgagtgcggccaccacgccttcagcaactac

SEQ ID NO: 40975 - DNA, 358 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcggatcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 40976 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagaaatcccacctcactgcttcaaacgctccatccctcgctccttctcctacctcctcttcgacatcctcgtctcctcctccctctaccacctctccacagcctacttccctctcctcccccaccctctcccttccctcacctggcccctctgctgggcctgcaaaggctgcgtcctaacgggcctctgggtcatcgcccacgaatgcggccaccacgccttcagcgactac

SEQ ID NO: 40977 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40978 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 40979 - DNA, 333 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40980 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccctggcgacctcaagaaagcaatcccacctcactgcttcaaacgctccatcccacgctccttctcctcttcgacatcatcatctcctcctcggctcctccctctaccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 40981 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgccagacaccacccttcacctcaagaaaccaatcccacctcactgcttcaaacgctccatcccacgctccttctcctcttcgacatcatcatctcctcctcggctcctccctctaccacctctccacagcctactcccctctcccttacctcgcctgacccctctactgggcctgccaaggctgcgtcctaacgggcctctgggtcatagcccacgagtgcggccaccacgccttcagcgactac

SEQ ID NO: 40982 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcacgacctcaagaaagcaatcccacctcactgcttcaaacgctccatccctcgctccttctcctacctcctcttcgacatcctcgtctcctcctccctctaccacctctccacagcctacttccctctcctcccccaccctatcccttacctcgcctggcccctctactgggcctgccaaggctgcgtcctaacgggcctctgggtcatcgcccacgaatgcggccaccacgccttcagcgactac

SEQ ID NO: 40983 - DNA, 354 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40984 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacttggcctgccaaggctgcgtcctaacgggcctctgggtcatcgcccacgaatgcggccaccacgccttcagcgactac

SEQ ID NO: 40985 - DNA, 328 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40986 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcaagacctcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 40987 - DNA, 315 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcagcgactac

SEQ ID NO: 40988 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 40989 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40990 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccctgaaaccaaaaccctcaaacgcgtcccctgcgagacaccacccttcactctaaagcaatcccacctcactgcttcaaacgctccatccctcgctccttctcctacctcctcttcgacatcctcgtcgcctcctccctctaccacctctccacagcctacttccctctcctccctcaccctctcccttacctcgcctggcccctctacttggcctgccaaggctgcgtcctaaccggcctctgggtcatcgcccacgaatgcggccaccacgccttcagcgactac

SEQ ID NO: 40991 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacccctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 40992 - DNA, 335 bp, Artificial
  Mutation in BnaC.FAD2.b introduced by TALE nuclease pair BnFAD2_T03
caggatccatgggtgcaggtggaagaatgcaagtctctcctccctccagctaccccgaaaccaaaaccctcaaacgcgtcccctgcgagacaccaccattcactcagacctcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40993 - DNA, 385 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcccacggcttgaccccccagcaggtggtggccatcgccagcaatggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40994 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctggcccctctactgggcctgccagggctgcgtcctaacgggcctctgggtcatagcccacgagtgcggccaccacgccttcagcgactac

SEQ ID NO: 40995 - DNA, 293 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 40996 - DNA, 358 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggatcggagacctcaagaaagcaatcccacctcactgcttcaaacgctccatccctcgctccttctcctacctcctcttcgacatcctcgtctcctcctccctctaccacctctccacagcctacttccctctcctcccccaccctcgcccttccctcgcctggcccctctactgggcctgccaaggctgcgtcctaacgggcctctgggtcatagcccacgagtgcggccaccacgccttcagcgactac

SEQ ID NO: 40997 - DNA, 358 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggatcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 40998 - DNA, 385 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcccacggcttgaccccccagcaggtggtggccatcgccagcaatggagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 40999 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41000 - DNA, 342 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttccctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 41001 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcccgccaaggctgcgtcctaacgggcctctgggtcatcgcccacgaatgcggccaccacgccttcagcgactac

SEQ ID NO: 41002 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccgcgccttcagcgactac

SEQ ID NO: 41003 - DNA, 378 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcctgcttgccaccgccattgctggcgatggccaccacctttgacctcaagaaagcaatcccacctcactgcttcaaacgctccatcccacgctccttctcctcttcgacatcatcatctcctcctcggctcctccctctaccacctccccacagcctacttccctctcccttacctcgcctgacccctctactgggcctgccaaggctgcgtcctaacgggcctctgggtcatagcccacgagtgcggccaccacgccttcagcgactac

SEQ ID NO: 41004 - DNA, 347 bp, Artificial
  Mutation in BnaC.FAD2.b introduced by TALE nuclease pair BnFAD2_T03
caggatccatgggtgcaggtggaagaatgcaagtgtctgctccctccaagaagtctgaaaccgacaccatcaagcgcgtaccctgcgagacaccgcccttcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttgcctcgcctggcccctctacggggcctgccaaggctgcgtcctaacgggcctctgggtcatcgcccacgaatgcggccaccacgccttcagcgactac

SEQ ID NO: 41005 - DNA, 382 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacagccgctggaccgtctccagcgcctgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41006 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacggagacctcaagaaagcaatcccacctcactgcttcaaacgctccatccctcgctccttctcctacctcctcttcgacatcatcatctcctcctcggctcctccctctaccacctctccacagcctacttccctctctcctacttcgcctggcctctctactgggcctgccaagggtgcgtcctaaccggcgtctgggtcatagcccacgagtgcggccaccacgccttcagcgactac

SEQ ID NO: 41007 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcctttctttctggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41008 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcctttttacggttcctctccctcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41009 - DNA, 366 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgcaattaatacgcgtaccgctagccaggaagagtttgtagaaacgcaaaacggagacctcaagaaagcaatcccacctcactgcttcaaacgctccatccctcgctccttctcctacctcctcttcgacatcctcgtctcctcctccctcaccctctctcctacttcgcctggcctctctactgggcctgccaagggtgcgtcctaaccggcgtctgggtcatagcccacgagtgcggccaccacgccttcagcgacac

SEQ ID NO: 41010 - DNA, 423 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcaggcccacggcttgaccccggagcaggtggtggccatcgccagccacgatggcggcaagcaggcgctggagacgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41011 - DNA, 341 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41012 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctccccacagcctacttccctctcccttacctcgcctgacccctctactgggcctgccaaggctgcgtcctaacgggcctctgggtcatcgcccacgaatgcggccaccacgccttcagcgactac

SEQ ID NO: 41013 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41014 - DNA, 350 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41015 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacctacctcaagaaagcaatcccacctcactgcttcaaacgctccatcccacgctccttctcctcttcgacatcatcatctcctcctcggctcctccctctaccacctctccacagcctacttccctctcccttacctcccctgacccctctactgggcctgccaaggctgcgtcctaacgggcctctgggtcatagcccacgagtgcggccaccacgccttcagcgactac

SEQ ID NO: 41016 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 41017 - DNA, 408 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccactcaaatccgctcccggcggatttgtcctactcaggagagcgttcaccgacaaacaacagataaaacgaagacctcaagaaagcaatcccacctcactgcttcaaacgctccatccctcgctccttctcctacctcctcttcgacatcctcgtctcctcctccctctaccacctctccacagcctacttccctcccctcccccaccctctcccttacctcgcctggcccctctactgggcctgccaaggctgcgtcctaacgggcctctgggtcatcgcccacgaatgcggccaccacgccttcagcgactac

SEQ ID NO: 41018 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagcctgcgtcctaactggcctctgggtcatagcccacgagtgcggccaccacgccttcagcgactac

SEQ ID NO: 41019 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41020 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 41021 - DNA, 411 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacggtccagcggctgttgccggtgctgtgccaggcccacggcttgacccctcagcaggtggtggccatccccagcaatggcggcggcaggagacctcaagaaagcaatcccacctcactgcttcaaacgctccatcccacgctccttctcctcttcgacatcatcatctcctccccggctcctccctctaccacctcgccacagcctacttccctctccctgtcctcgcctgacccctctactgggcctgccaaggctgcgtcctaacgggcctctgggtcatcgcccacgaatgcggccaccacgccttcagcgactac

SEQ ID NO: 41022 - DNA, 429 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcactgccaggcgccaaactaagcagaaggccatccgtcaccagcggctgttgccggtgctgtgccaggcccacggcttgaccccggagcaggtggagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41023 - DNA, 279 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatccctcgctccttctcctacctcctcttcgacatcctagtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 41024 - DNA, 344 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaactcaagaaagcaatcccaccgcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41025 - DNA, 397 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagccgaacgaccgagcgcagcgagtcagtgagcgaggaagcggaagagcgcccaatacgcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 41026 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 41027 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgccccctctactgggcctgccaaggctgcgtcctaacgggcctctgggtcatagcccacgagtgcggccaccacgccttcagcgactac

SEQ ID NO: 41028 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcagacgcgtcccctgcgagacaccaccagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41029 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 41030 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 41031 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagacctcaagaaagcaatcccacctcactgcttcaaacgctccatcccacgctccttctcctcttcgacatcatcatctcctcctcggctcctccctctaccacctctccacagcctacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 41032 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatagcccacgagtgcgaccaccacgccttcagcgactac

SEQ ID NO: 41033 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41034 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgacta

SEQ ID NO: 41035 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctcacgggcctctgggtcatcgcccacgaatgcggccaccacgccttcagcgactac

SEQ ID NO: 41036 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccccctaccgggcctgccaaggctgcgtcctaacgggcctctgggtcatcgcccacgaatgcggccaccacgccttcagcgactac

SEQ ID NO: 41037 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactacc

SEQ ID NO: 41038 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41039 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaattcggccaccacgccttcagcgactac

SEQ ID NO: 41040 - DNA, 326 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41041 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcagtcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41042 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttacctcaagaaagcaatcccacctcactgcttcaaacgctccatcccacgctccttctcctacctcctcttcgacatcctcgtctcctcctccctctaccacctctccacagcctacttccctctcctcccccaccctctccctttcctcgcctggcccctctactgggcctgccaagggtgcgtcctaaccggcgtctgggtcatagcccacgagtgcggccaccacgccttcagcgactac

SEQ ID NO: 41043 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgtgcctctgggtcatcgcccacgaatgcggccaccacgccttcagcgactac

SEQ ID NO: 41044 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatagcctttctagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41045 - DNA, 337 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccacctcactgcttcaaacgctccatcccacgctccttctcctcttcgacatcatcatctcatcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41046 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41047 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagaccccacccttcactctcggcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41048 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 41049 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacactcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41050 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcgaccaccacgccttcagcgactac

SEQ ID NO: 41051 - DNA, 412 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggctgttgccggtgctgtgccaggcccacggcttgaccccggagcaggtggtggccatcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41052 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaataaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41053 - DNA, 341 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcgacctcaagaaagcaatcccacctcactgcttcaaaccctccatcccaccctccttctcctcttcgacatcatcatctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 41054 - DNA, 384 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtacttcaagtgtctcctccctccaaaaagtctgaaaccgacaacatacgcaaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41055 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 41056 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcacctggcccctctactgggcctgccaaggctgcgtcctaacgggcctctgggtcatcgcccacgaatgcggccaccacgccttcagcgactac

SEQ ID NO: 41057 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccaaaaccaaaaccctcaaacgcgtcccctgcgagacaccacccttcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 41058 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacaagacctcaagaaagcaatcccacctcactgcttcaaacgctccatcccaagctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41059 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 41060 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 41061 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttgcctcgcctggcccctctacggggcctgccaaggctgcgtcctaacgggcctctgggtcatcgcccacgaatgcggccaccacgccttcagcgactac

SEQ ID NO: 41062 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccacctcactgcttcaaacgctccatccctcgctccttctcctacctcctcttcgacatcctcgtctcctcctccctctaccacctctccacagtctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41063 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41064 - DNA, 419 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcaacagccgctggaccgtctccagcgcctgcttgccaccattattgctggcgatggccaccacctgccatcccacgttccagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41065 - DNA, 335 bp, Artificial
  Mutation in BnaC.FAD2.b introduced by TALE nuclease pair BnFAD2_T03
caggatccatgggtgcaggtggaataatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41066 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccagagacctcaagaaagcaatcccacctcactgcttcaaacgctccatcccacgctccttctcctcttcgccatcatcatctcctcctcggctcctccctctaccacctctccacagcctacttccctctcccttacctcgccggacccctctacggggcctgccaaggctgcgtcctaacgggcctctgggtcatagcccacgagtgcggccaccacgccttcagcgactac

SEQ ID NO: 41067 - DNA, 438 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtggccatcgccagcaataatggtggcaggtggtggccatcgccagcaatggcggtggcaagcaggcgctggagacggtccagcggctgttgccggtgcgagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41068 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgctgccaccacgccttcagcgactac

SEQ ID NO: 41069 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccaagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41070 - DNA, 400 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctggcaacgctgcgatcatgtcctgatacttgacagcgacggtccctatcgcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41071 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 41072 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccatcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41073 - DNA, 333 bp, Artificial
  Mutation in BnaC.FAD2.b introduced by TALE nuclease pair BnFAD2_T03
caggatccattggtgcaggtggaagaatgcaagtctctcctccctccagctcccccggaaccaacaccctcaaacgcgtcccctgcgagacaccaccattcactcaacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41074 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41075 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgaccactctactgggcctgccaaggctgtgtcctaacgggcctctgggtcatagcccacgagtgcggccaccacgccttcagcgactac

SEQ ID NO: 41076 - DNA, 246 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgctagacaccacccttaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 41077 - DNA, 329 bp, Artificial
  Mutation in BnaC.FAD2.b introduced by TALE nuclease pair BnFAD2_T03
catgatccatgggtgcaggtggaagaatgcaagtgtctcctccctccaaaaagtctgaaaccgacaacatcaagcgcgtaccctgcgagacaccgcccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41078 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 41079 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41080 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 41081 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcaagacaccaccattcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41082 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41083 - DNA, 349 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaacatcaagcgcgtaccctgcgagacaccgcccttcactgtgaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41084 - DNA, 345 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccccccttcagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgtgtcctaacgggcctctgggtcatcgcccacgaatgcggccaccacgccttcagcgactac

SEQ ID NO: 41085 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41086 - DNA, 355 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 41087 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41088 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactgagacctcaagaaagcaatcccacctcactgcttcaaacgctccatccctcgctccttctcctacctcctcttccacatcctcgtctccccctccctctaccacctctccacagcctacttccctctccccccccaccctctcccttccctcgcctggcccctctactgggcctgccaaggctgcgtcctaacgggcctctgggtcatcgcccacgaatgcggccaccacgccttcagcgactac

SEQ ID NO: 41089 - DNA, 335 bp, Artificial
  Mutation in BnaC.FAD2.b introduced by TALE nuclease pair BnFAD2_T03
caggatcctgggtgcaggtggaagaatgcaagtgtctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41090 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcacagcccacgagtgcggccaccacgccttcagcgactac

SEQ ID NO: 41091 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 41092 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 41093 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggccgcgtcctaacgggcctctgggtcatcgcccacgaatgcggccaccacgccttcagcgactac

SEQ ID NO: 41094 - DNA, 279 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 41095 - DNA, 333 bp, Artificial
  Mutation in BnaC.FAD2.b introduced by TALE nuclease pair BnFAD2_T03
caggatccatgggtgcaggtggaagaatgcaagtctctcctccctccagatcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41096 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcctcttcgacatcctcgtctcctcctccctctaccacctctccacagcctacttccctctcctcccccaccctcgcccttacctcgcctggcccctctactgggcctgccaaggctgcgtcctaacgggcctctgggtcatcgcccacgaatgcggccaccacgccatcagcgactac

SEQ ID NO: 41097 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagtccacgagtgcggccaccacgccttcagcgactac

SEQ ID NO: 41098 - DNA, 347 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactcgcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41099 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 41100 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcaccgcccacgaatgcggccaccacgccttcagcgactac

SEQ ID NO: 41101 - DNA, 344 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41102 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacccacaaacgcgtcccctgcgagacaccaccattcactctagacctcaagaaagcaatcccaccgcactgtttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41103 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcttcaaacgctccatcccacgctccttctcctcttcgacatcatcatctcctcctcggctcctccctctaccacctctccaaagcctacttccctctcccttacctcgcctgacccctctactgggcctgccaaggctgcgtcctaacgggcctctgggtcatagcccacgagtgcggccaccacgccttcagcgactac

SEQ ID NO: 41104 - DNA, 325 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactcacctcaagaaagcaatcccacctcactgcttcaaacgctccatcccacgctccttctcctcttcgacatcatcatctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41105 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgtcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41106 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctccctgacctcgcctgacccctctactgagcctgccaaggctgcgtcctaacgggcctctgggtcatcgcccacgaatgcggccaccacgccttcagcgactac

SEQ ID NO: 41107 - DNA, 348 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41108 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttccctcgcctggcccctctactgggcctgccaaggctgcgtcctaacgggcctctgggtcatagcccacgagtgcggccaccacgcctgcagcgactgc

SEQ ID NO: 41109 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctcaagaaagcaatcccacctcactgcttcaaacgctccatccctcgctccttctcctcttcgacatcatcatctcctcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41110 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccaccattcactcagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41111 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41112 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctccacggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41113 - DNA, 320 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctatcccacctcactgcttcaaacgctccatcccacgctccttctcctcttcgacatcatcatcccctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 41114 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 41115 - DNA, 313 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccacctcactgcttcaaacgctccatccctcgctccttctcctacctcctcttcgacatcctcgtctcctcctccctcaccctctctcctacttcgcctggcctctctactgggcctgccaagggtgcgtcctaactggcctctgggtcatcgcccacgaatgcggccaccacgccttcagcgactac

SEQ ID NO: 41116 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttgcctcgcctggcccctctacggggcctgccaaggctgcgtcctaacgggcctctgggtcatcgcccacgaatgcggccaccacgccttcagcgactcc

SEQ ID NO: 41117 - DNA, 326 bp, Artificial
  Mutation in BnaC.FAD2.b introduced by TALE nuclease pair BnFAD2_T03
caggatccatgggtgcaggtggaagaatacaagtctctcctccctccagctcccccggaaccaacaccctcaaacgcgtcccctagcaggcgctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41118 - DNA, 433 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaggataaaattgtagctgggcgcaacatagcaactaatcttcaattacggcctcaaaacctcccgcaactcgggaggctcggacatctcaagaaagcaatcccacctcactgcttcaaacgtcccacccctcgctccttctcctacctcctctccgacatccccttcgcctcctccctctaccacctctccacaacctacttccctcccctcccccaccctctcccttacctcgcctggcccctctactgggcctgccaaggctgcgtcctaacgggcctctgggtcatcgcccacgaatgcggccaccacgccttcagcgactac

SEQ ID NO: 41119 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctccccccccaccctctcccttacctcgcctggcctctctactgggcctgccaagggtgcgtcctaacgggcctctgggtcatcgcccacgaatgcggccaccacgccttcagcgactac

SEQ ID NO: 41120 - DNA, 405 bp, Artificial
  Mutation in BnaC.FAD2.b introduced by TALE nuclease pair BnFAD2_T03
caggatccatgggtgcaggtggaagaatgcaagtctctcctccctccagctcccccggaaccgacaccatcaagcgcgtaccctgcgagacaccgcccttcactgtcggcaacagccgctggaccgtctccagcgcctgcttgccaccattattgctggcgagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41121 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41122 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattagacctcaagaaagcaatcccacctcactgcttcaaacgctccatcccacgctccttctcctcttcgacatcatcatctcctcctctgctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41123 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgacctcaagaaagcaatcccacctcactgcttcaaacgctccatcccacgctccttctcctacctcctcttcgacatcctcgtctcctcctccctctaccacctctccacagcctacttccctctcccttacctcgcctggcccctctactgggcctgccaaggctgcgtcctaacgggcctctgggtcatcgcccacgaatgcggccaccacgccttaagcgactac

SEQ ID NO: 41124 - DNA, 303 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcactgcttcaaacgctccatctcacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41125 - DNA, 292 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41126 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41127 - DNA, 308 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41128 - DNA, 321 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgttatcgagacctcaagaaagcaatcccacctcactgcttcaaacgctccatcccacgctccttctcctcttcgacatcatcatctcctcctcggctcctccctctaccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 41129 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgcttcaaacgctccatcccacgctccttctcctcttcgacatcatcatctcctcctcgactcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41130 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccaccattcactctcaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41131 - DNA, 376 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgaggcccacggcttgaccccggagcaggtggtggccatcgcctggcacgatggagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41132 - DNA, 369 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacggtccagcggctgttgccggtgctgtgccaggcccacggcttgaccccggagcaggtggtggccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctcctgggcctgccaaggctgcgtcctaacgggcctcttggtcatagcccacgagtgcggccaccacgccatcagcgactac

SEQ ID NO: 41133 - DNA, 369 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacggtccagcggctgttgccggtgctgtgccaggcccacggcttgaccccggagcaggtggtggccagacctcaagaaagcaatcccacctcactgcttcaaacgctccatcccacgctccttctcctcttcgacatcatcatctcctcctcggctcctccctctaccacctctccacagcctccttccctctcccttacctcgcctgacccctctactgggcctgccaaggctgcgtcctaacgggcctcttggtcatagcccacgagtgcggccaccacgccttcagcgactac

SEQ ID NO: 41134 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41135 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcgaccaccacgccttcagcgactac

SEQ ID NO: 41136 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctgagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaatggtgcgtcctaaccggcgtctgggtcatagcccacgagtgcggccaccacgccttcagcgactac

SEQ ID NO: 41137 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccatcaagcgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41138 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 41139 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagctactac

SEQ ID NO: 41140 - DNA, 381 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctcggccttctgcttagtttgatgcctggcagtttatggcgggcataagacctcaagaaagcaatcccacctcactgcttcaaacgctccatcccacgctccttctcctcttcgacatcatcatctcctcctccgctcctccctctaccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 41141 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccagagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41142 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41143 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41144 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 41145 - DNA, 416 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggggggaaagccggcgaacgtggcgagaaaggaagggaagaaagcgaaaggagcgggcgctaggagacctcaagaaagcaatcccacctcactgcttcaaacgctccatccctcgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41146 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtacaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41147 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctccttctcctacctcctcttcgacatcctcgtctcctcctcactctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41148 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 41149 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcagacctcaagaaagcaatcccacctcactgcttcaaacgctccatccctcgctccttctcctacctcctcttcgacctcatcatctcctcctcggctcctccctctaccacctctccacagcctacttccctctcccttacctcgcctggcctctctactgggcctgccaagggtgcgtcctaacgggcctctgggtcatcgcccacgaatgcggccaccacgccttcagcgactac

SEQ ID NO: 41150 - DNA, 349 bp, Artificial
  Mutation in BnaC.FAD2.b introduced by TALE nuclease pair BnFAD2_T03
caggatccattggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41151 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 41152 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 41153 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41154 - DNA, 317 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacctcaagaaagcaatcccacctcactgcttcaaacgctacatcccacgctccttctcctcttcgacatcatcatctcctcctcggctccttcctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41155 - DNA, 460 bp, Artificial
  Mutation in BnaC.FAD2.b introduced by TALE nuclease pair BnFAD2_T03
caggatccatgggtgcatgtggaagaatgcaagtctctcctccctccagctcccccgaaaccaaaaccctcaaacgcgtcccctgcgagacaccacccttcacactcttggcctgcctcggcgggcgtcctgcgctggatgcagtgaaaaagggattgggggatcctatcagccgttcccagctggtgaagtccgagttggaggagaagaaatccgagacctcaagaaaacaatcccacctcactgcttcaaacgctccatcccacgctccttcccctacctcctcttcgacatcctcgcctcctcccccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41156 - DNA, 342 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgggggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41157 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 41158 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 41159 - DNA, 347 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactctcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41160 - DNA, 355 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggagaactcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtcctaacgggcctctgggtcatcgcccacgaatgcggccaccacgccttcagcgactac

SEQ ID NO: 41161 - DNA, 399 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcggatggcctttttgcgtttctacaaactcttcctggctagcggtactcggagacctcaagaaagcaatcccacctcactgcttcaaacgctccatccctcgctccttctcctacctcctcttcgacatcctcgtctcctcctccctctaccacctctccacagcctacttccctcccctcccccaccctctcccttacctcgcctggcccctctactgggcctgccaaggctgcgtcctaacgggcctctgggtcatcgcccacgaatgcggccaccacgccttcagcgactac

SEQ ID NO: 41162 - DNA, 350 bp, Artificial
  Mutation in BnaC.FAD2.b introduced by TALE nuclease pair BnFAD2_T03
caggatccatttgtgcagttggaagaatgcaagtgtctcctccctccaaaaagtctgaaacctacaacatcaagcgcgtaccctgcgagacaccgcccttcactgtagaactcaagaaagcaatcccaccgcactgtttcaaacgctcgatccctcgctccttctcctacctcctcttcgacatcctcgtctcctcctccctctaccacctctccacagcctacttccctctcctcccccaccctctccctcacctcgcctggcccctctactgggcctgccaaggctgcgtcctaacgggcctctgggtcatcgcccacgaatgcggccaccaagccttcagagactac

SEQ ID NO: 41163 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaacctacaacatcaagcgcgtaccctgcgagacaccgcccttcactgtagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggcaaacaagccttcagagactac

SEQ ID NO: 41164 - DNA, 347 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41165 - DNA, 335 bp, Artificial
  Mutation in BnaC.FAD2.b introduced by TALE nuclease pair BnFAD2_T03
taggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagttcggccaccacgccatcagcgactac

SEQ ID NO: 41166 - DNA, 342 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgctcacgaatgcggccaccacgccttcagcgactac

SEQ ID NO: 41167 - DNA, 306 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41168 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41169 - DNA, 356 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactttgctccaagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccatctactgggcctgccaaggctgcgtcctaacgggcctctgggtcatcgcccacgaatgcggccaccacgccttcagcgactac

SEQ ID NO: 41170 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 41171 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 41172 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaacaaacaccctcaaacgcgtcccctgcgagacaccaccattcactctcctcaagaaagcaatcccacctcactgcttcaaacgctccatcccacgctccttctcctcttcgacatcatcatctcctcctcggctcctccctctaccacctctccacagcctacttccctctctcctacttcgcctggcctctctactgggcctgccaagggtgcgtcctaaccggcgtctgggtcatagcccacgagtgcggccaccacgccttcagcgactac

SEQ ID NO: 41173 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctacctcctcttcgacatcctcgtctcctcctccctctaccccctctccacagcccacttccctctcctcccccaccctctcccttacctcgcctggcccctctacggggcctgccaaggctgcgtcctaacgggcctctgggtcatagcccacgagtgcggtcaccacgccttcagcgactac

SEQ ID NO: 41174 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacccacaaacgcgtcccctgcgagacaccaccattcactcttgacctcaagaaagcaatcccacctcactgcttcaaacttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41175 - DNA, 332 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagccaccacccttcactctctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41176 - DNA, 339 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctttcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatcgcccacgagtgcggccaccacgccttcagcgactac

SEQ ID NO: 41177 - DNA, 325 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41178 - DNA, 280 bp, Artificial
  Mutation in BnaC.FAD2.b introduced by TALE nuclease pair BnFAD2_T03
caggatccatgggtgcaggtggaagaatgcaagtctcgacctcaagaaagcaatcccacctcactgcttcaaacgctccatccctcgctccttctcctacctcctcttcgacatcctcgtctcctcctccatctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41179 - DNA, 268 bp, Artificial
  Mutation in BnaC.FAD2.b introduced by TALE nuclease pair BnFAD2_T03
caggatccatgggtgcaggtggtggggtcaagctgtggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41180 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcaagacaccacccttcactgacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41181 - DNA, 379 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggtggtggccatcgccagcaatattggtggcaagcaggcgctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatcgcccacgaatgcggccaccacgccttcagcgactac

SEQ ID NO: 41182 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccacccttcacatgagacctcaagaaggcaatcccacctcactgcttcaaccgctccatcccaccctccttctcctcttcgccatcatcatctcctcctcgacgcctccctctcccacctctccacagcctcctaccctctcccttacctcgcctgacccctctactgggcctgccaaggctgcgtcctaacgggcctctgggtcatcgcccacgaatgcggccaccacgccttcagcgactac

SEQ ID NO: 41183 - DNA, 348 bp, Artificial
  Mutation in BnaC.FAD2.b introduced by TALE nuclease pair BnFAD2_T03
caggatccatgggtgcaggtggaagaatgtaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgcgcctggcccctctactgggcctgccaaggctgcgtcctaacgggcctctgggtcatcgcccacgaatgcggccaccacgccttcagcgactac

SEQ ID NO: 41184 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccacctcactgcttcaaacgctccatccctcgctccttctcctacctcctcttcgacatcctcgtctcctcctcctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41185 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcccacctcactgcttcaaacgctccatccctcgctccttctcctacctcctcttcgacatcctcgtctccccctcactccaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41186 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 41187 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccctcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctcaactgggcctgccaaggctgcgtcctaacgggcctctgggtcatcgcccacgaatgcggccaccgcgccttcagcgactac

SEQ ID NO: 41188 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 41189 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcgaacgctccatcccacgctccttctcctcttcgacatcatcatctcctcctccctctaccacctctccacagcctacttccctctcctcccccaccctctcccttacctcgcctggcccctctactgggcctaccaaggctgcgtcctaacgggcctctgggtcatcgcccacgaatgcggccaccacgccttcagcgactac

SEQ ID NO: 41190 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctggcccctctactgggcctgccaaggctgcgtcctaacgggcctctgggtcatcgcccacgaatgcggccaccacgccttcagcgactac

SEQ ID NO: 41191 - DNA, 349 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41192 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41193 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccgcgcccctcttctgggcctgccaaggctgcgtcctaacgggcctctgggtcatcgcccacgaatgcggccaccacgccttcagcgacgac

SEQ ID NO: 41194 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41195 - DNA, 432 bp, Artificial
  Mutation in BnaC.FAD2.b introduced by TALE nuclease pair BnFAD2_T03
caggatccatgggtgcatgtggaagaatgcaagtctctcctccctccagctcccccggaaccaacaccctcaaacgcgtcccctgcgagacaccaccattcactctcagcctggagacggtccagcggctgttgccggtgctgtgccaggcccacggcttgaccccggagcagggggtggccatcgccagccacgatggcggagacctcaagaaagcaatcccacctcactgcttcaaacgctccatcccacgctccttctccccttcgccatcatcacctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41196 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41197 - DNA, 349 bp, Artificial
  Mutation in BnaC.FAD2.b introduced by TALE nuclease pair BnFAD2_T03
caggatccatgggtgcaggtggaagagtgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccccagcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 41198 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 41199 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcaagaaagcaatcccacctcactgcttcaaacgctccatccctcgctccttctcctacctcctcttcgacatcctcgtctcctcctccctctaccacctctccacagcctacttccctctcctaccccaccctctcccttacctcgcctggcccctctactgggcctgccaaggctgcgtcctaacgggcctctgggtcatcgcccacgaatgcggccaccacgccttcagcgactac

SEQ ID NO: 41200 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgcaccatccctcgctccttctcctacctcctcttcgacatcctcgtctcctcctccctctaccacctctccacagcctacttccctctcccccccccccctctcccttacctcgcctggcccctctactgggcctgccaaggctgcgtcctaacgggcctctgggtcatcgcccacgaatgcggccaccacgccttcagcgactac

SEQ ID NO: 41201 - DNA, 352 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41202 - DNA, 327 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgcctaggctgcgtcctaacgggcctctgggtcatagcccacgagtgcggccaccacgccttcagcgactac

SEQ ID NO: 41203 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgtgcctctgggtcatagcccacgagtgcggccaccacgccttcagcgactac

SEQ ID NO: 41204 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctggcccctctactgggcctgccaaggctgcgtcctaacgggcctctgggtcatcgcccacgaatgcggccaccacgccttcagcgactac

SEQ ID NO: 41205 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccgtcggcgactac

SEQ ID NO: 41206 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctccctcaccctctctcatacttcgcctggcctctctactgggcctgccagggctgcgtcctaaccggcgtctgggtcatagcccacgagtgcggccaccacgccttcagcgactac

SEQ ID NO: 41207 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41208 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41209 - DNA, 347 bp, Artificial
  Mutation in BnaC.FAD2.b introduced by TALE nuclease pair BnFAD2_T03
caggatccatgggtgtaggtggaagaatgcaagtgtctcctccctccaagaagtctgaaaccgacaacatcaagcgcgtaccctgcgagacaccgcccttcactgaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41210 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41211 - DNA, 398 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttcacgccagcaacgcggcctttttacggttcctggccttttgctggccttttgctcacatgtagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41212 - DNA, 349 bp, Artificial
  Mutation in BnaC.FAD2.b introduced by TALE nuclease pair BnFAD2_T03
caggatccatgggtgcaggtggaagaatgcaagtctctcctccctccagctccccgaaaccaaaaccctcaaacgcgtcccctgcgagacaccacccttcactctgacctcaagaaagcaatcccacctcactgcttcaaacgctccatccctcgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41213 - DNA, 439 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagcgcctgcttgccaccgccattgctggcgatggccaccacctgctccggggtcaagccgtgggcctggcacagcaccggcaacagccgctgacctcaagaaagcaatcccacctcactgcttcaagcgctccatccctcgctccttctcctacctcccctccgacatcctcgtccccccccccctctcccacctccccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 41214 - DNA, 296 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccgccatcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41215 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 41216 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 41217 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctaccaaggctgcgtcctaacgggcctctgggtcatcgcccacgaatgcggccaccacgccttcagcgactac

SEQ ID NO: 41218 - DNA, 366 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgaatgcatctagatccaatgatcatgagcggagacctcaagaaagcaatcccacctcactgcttcaaacgctccatccctcgctccttctcctacctcctcttcgacatcctcgtctcctcctccctctaccacctctccacagcctacttccctctcccttccctcgcctgccccctctactgggcctgccaaggctgcgtcctaacgggcctctgggtcatagcccacgagtgcggccaccacgccttcagcgactac

SEQ ID NO: 41219 - DNA, 430 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagcgcctgctgccggtgctgtgccaggcccacggcttgaccccccagcaggtggtggccatcgccagcaataatggtggcagacctcaagaaagcaatcccacctcactgcttcaaacgctccatccctcgctccttctcctacctcctcttcgacacccgcgactccgcctccctctcccacctctccacggcctacttccctctcctccccccccccctcccttacctcgcctggcccctctactgggcctgccaaggctgcgtcctaacgggcctctgggtcatcgcccacgagtgcggccaccacgccttcagcgactac

SEQ ID NO: 41220 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcgggtcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41221 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaacctcaagaaagcaatcccacctcactgcttcaaacgctccatcccacgccccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41222 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccggacccaacaccctcaaacgggtcccctgcgagacaccaccattcactctcctcaagaaagcaatcccacctcactgcttcaaacgctccatcccacgctccttctcctacctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 41223 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaaccggcgtctgggtcatagcccacgaatgcggccaccacgccttcagcgactac

SEQ ID NO: 41224 - DNA, 350 bp, Artificial
  Mutation in BnaC.FAD2.b introduced by TALE nuclease pair BnFAD2_T03
ccggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41225 - DNA, 336 bp, Artificial
  Mutation in BnaC.FAD2.b introduced by TALE nuclease pair BnFAD2_T03
caggatccatgggtgcaggtggaagaatgcaagtctctcctccctcaagctcccccggaaccaacaccctcaaacgcgtcccctgcgagacaccaccattcactcaggacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41226 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41227 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcatcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41228 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctagacctcaggaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41229 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagagaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttccctcgcctgtcccctctactgggcctgccaaggctgcgtcctaacgggcctctgggtcatagcccacgagtgcggccaccacgccttcagcgactac

SEQ ID NO: 41230 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactaagacctcaagaaagcaatcccacctcactgcttcaaacgctccatcccacgctccttctcctcttcgacatcatcatctcctcctcggctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 41231 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactaaagcaatcctacctcacttcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcttggtcatagcccacgaatgcggccaccacgccttcagcgactac

SEQ ID NO: 41232 - DNA, 313 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctcaccctctctcctacttcgcctggcctctctactgggcctgccaagggtgcgtcctaaccggcgtctgggtcatagcccacgagtgcggccaccacgccttcagcgactac

SEQ ID NO: 41233 - DNA, 394 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattggagacagggagacttttttttttttttttttatctttaatcaaatttgtacagtagaggggtcagacctcaagaaagcaatcccacctcattgcttcaaacgctccatcccacgctccttctcctcttcgacatcatcatctcctcctcggctcctccctctaccacctccccacagcctacttccctctcccttacctcgcctgacccctctactgggcctgccaaggctgcgtcctaacgggcctctgggtcatcgcccacgaatgcggccaccacgccttcagcgactac

SEQ ID NO: 41234 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccatcccacgctccttctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 41235 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcgcccaccacgccttcagcgactac

SEQ ID NO: 41236 - DNA, 323 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacacctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41237 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41238 - DNA, 283 bp, Artificial
  Mutation in BnaC.FAD2.b introduced by TALE nuclease pair BnFAD2_T03
caggatccatgggtgcaggtggaagcatgcaagtctctcctctctgagacctcaagaacgcaatcccacctcactgcttcaaactctccatcccacgctcctcctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41239 - DNA, 334 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctccatcccacgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41240 - DNA, 378 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcctgcttgccaccgccattgctggcgatggccaccacctttgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 41241 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41242 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 41243 - DNA, 335 bp, Artificial
  Mutation in BnaC.FAD2.b introduced by TALE nuclease pair BnFAD2_T03
caggatccatgggtgcaggtggaagaatgcaagtctctcctccctcgagctcccccgaaaccaaaaccctcaaacgcgtcccctgcgagacaccaccattcactctcacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 41244 - DNA, 357 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactctccgccggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 41245 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgaccccgctactgagcctgccaaggctgcgtcctaacgggcctctgggtcatagcccacgagtgcggccaccacgccttcagcgactac

SEQ ID NO: 41246 - DNA, 350 bp, Artificial
  Mutation in BnaC.FAD2.b introduced by TALE nuclease pair BnFAD2_T03
caggatcatgggtgcaggtggaagaatgcaagtgtctcctccctccaaaaagtctgaaaccgacaacatcaagcgcgtaccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41247 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41248 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccatctcccttacctcgcctgacccctctacggggcctgccaaggctgcgtcctaacgggcctctgggtcatagcccacgagtgcggccaccacgccttcagcgactac

SEQ ID NO: 41249 - DNA, 443 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcactgccaggcgtcaaactaagcagaaggccatccgtctccagcgcctgttgccggtgctgtgccaggcccacggcttgaccccggagcaggtggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41250 - DNA, 322 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaagcgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41251 - DNA, 354 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 41252 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccacctcactgcttcaaacgctccatccctcgctccttctcctacctcctcttcgacatcctcgtctcctcctccctctaccacctctccacagcctacttccctctcctcccccgccctctcccttacctcgcctggcccctctactgggcctgccaaggctgcgtcctaacgggcctctgggtcatcgcccacgaatgcggccaccacgccttcagcgactac

SEQ ID NO: 41253 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttgacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 41254 - DNA, 334 bp, Artificial
  Mutation in BnaC.FAD2.b introduced by TALE nuclease pair BnFAD2_T03
caggatccatgggtgcaggtggaagaatgcaagtctctcctccctccagctaccccgaaaccaaaaccctcaaacgcgtcccctgcgagacaccacccttcactctagacctcaagaaagcaatcccaccactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41255 - DNA, 372 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaagcgcgtaccctgcgagacaccgcccttcactgtcgccagccacgatggcggcaacagccgctggaccggagaactcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 41256 - DNA, 358 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctggcggcaagcaggcgctggaggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41257 - DNA, 440 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggaccgtctcagcggctgttgccaccgccattgctgtcgatggccaccacctgctggtagcggtggtttttttgtttgcaagcagcagattacgcgcagaaggtgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 41258 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaattccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41259 - DNA, 386 bp, Artificial
  Mutation in BnaC.FAD2.b introduced by TALE nuclease pair BnFAD2_T03
caggaatccatgggtgcaggtggaagaatgcaagtctctcctccctccagctcccccggaaccaacaccctcaaacgcgtcccatgcgagacaccaccattcactctcggcccacggcttgaccccccagcaggtggtggccatcgccagcaatggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41260 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 41261 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41262 - DNA, 347 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41263 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 41264 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcggagacctcaagaaagcaatcccacctcactgcttcaaacgctccatcccacgctccttctcctcttcgacatcatcatctcctcctcggctcctccctctaccatctctccacagcctacttccctctcccttacctcgcccgacccctctactgggcctgccagggctgcgtcctaaccggcgtctgggtcatagcccacgagtgcggccaccacgccttcagcgactac

SEQ ID NO: 41265 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41266 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccatcaagcgcgtcccctgcgagacaccacccttcactctcagacctcaacaaaacaatcccacctcactgcttcaaacgctccatcccacgctccttctcctcttcgacatcatcatctcctcctcggcgccgccctctaccacctccccacagcctacttccctctcccttacctcgcctggcccctctactgggcctgccaaggctgcgtcctaacgggcctcggggtcatagcccacgagtgcggccacgacgccttcagcgactac

SEQ ID NO: 41267 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaactaaaaccctcaaacgcgtcccctgcgagacaccaccattcactaaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41268 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcgctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41269 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagtaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 41270 - DNA, 397 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagccgaacgaccgagcgcagcgagtcagtgagcgaggaagcggaagagcgcccaatacgcggagacctcaagaacgcaatcccacctcactgcttcaaacgctccatcccacgctccttctcctcttcgacatcatcatctcctcctcggctcctccctctcccacatctccaccgcctacttccctctcccttacctcgcctgacccctctactgggcctgccaaggctgcgtcctaacgggcctctgggtcatagcccacgagtgcggccaccacgccttcagcgactac

SEQ ID NO: 41271 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatccctcgctccttctcctcttcgacatcatcatctcctcctcggctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 41272 - DNA, 394 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccagaacgggtagtgaattgcgcttgagatggtttaatttcaactttaatcattattgaattccctcgggtttcccacctcactgcttcaaacgctccatccctcgctacttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41273 - DNA, 315 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctcaccctctctcctacttcgcctggcctctctactgggcctgccagggctgtgtcctaacgggcctctgggtcatcgcccacgaatgcggccaccacgccttcagcgactac

SEQ ID NO: 41274 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcgcgactac

SEQ ID NO: 41275 - DNA, 346 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtctcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 41276 - DNA, 312 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccacctcactgcttcaaacgctccatcccacgctccttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcagcgactac

SEQ ID NO: 41277 - DNA, 294 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgtagacctcaagaaagcaatcccacctcactgcttcaaacgctccatcccacgctccttctcctcttcgacatcatcatctcctcctcggctcctcccccaccctctcccttacctcgcctggcccctctactgggcctgccaaggctgcgtcctaacgggcctctgggtcatcgcccacgaatgcggccaccacgccttcagcgactac

SEQ ID NO: 41278 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 41279 - DNA, 321 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgttatcgagacctcaagaaagcaatcccacctcactgcttcaaacgctccatcccacgctccttctcctcttcgacatcatcatctcctcctcggctcctccctctaccacctctccacagcctacttccctctcccttgcctcgcctgacccctctactgggcctgccaagcctgcgtcctaacgggcctctgggtcatagcccacgagtgcggccaccacgccttcagcgactac

SEQ ID NO: 41280 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgaacctcaagaaagcaatcccacctcactgcttcaaacgctccatcccacgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41281 - DNA, 391 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacggtccagcggctgttgccggtgctgtgccaggcccacggagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41282 - DNA, 397 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagtcaccaccattccggatggcctttttgcgtttctacaaactcttcctggctagcggtacgcgtattaattgcgttgcgagacctcaagaaagcaatcccacctcactgcttcaaacgctccatcccacgctccttctcctcttcgacatcatcatctcctcctcggctcctccctctaccacctctccacagcctacttccctctcccttaccgcgcctgacccctctacggggcctgccaaggctgcgtcctaacgggcctctgggtcatcgcccacgaatgcggcgaccacgccttccgcgactac

SEQ ID NO: 41283 - DNA, 386 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcaccggcaacagccgctggaccgtctccagcgcctgcttgccaccagagacctcaagaaagcaatcccacctcactgcttcaaacgctccatcccacgctccttctcctcttcgacatcatcatctcctcctcggctcctcccgctaccgcctctccgcagcctacttccctctcccttacctcgcctgacccctctactgggcctgccaaggctgcgtcctaacgggcctctgggtcatagcccacgagtgcggccaccacgccttcagcgactac

SEQ ID NO: 41284 - DNA, 386 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccatcaaacgcgtcccctgcgagacaccacccttcactctcggcaccggcaacagccgctggaccgtctccagcgcctgcttgccaccagagacctcaagaaagcaatcccacctcactgcttcaaacgccccatcccacgctccttctcctcttcgacatcatcatctcctcctcggctcctccctctaccacctctccacagcctacttccctctcccttacctcgcctgacccctctactgggcctgccaaggctgcgtccgaacgggcctctgggtcatagcccacgagtgcggccaccacgccttcagcgactac

SEQ ID NO: 41285 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 41286 - DNA, 350 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcggggtcatcgcccacgaatgcggccaccacgccttcatcgactac

SEQ ID NO: 41287 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtccccacgcgtcccagcaatggcggtggcaagcaggcgctggagacctcaagaaagcaatcccacctcactgcttcaaatgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41288 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtccccacgcgtcccagcaatggcggtggcaagcaggcgctggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41289 - DNA, 400 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggggtcaagccgtgggcctggcacagcaccggcaacagccgctggaccgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41290 - DNA, 329 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 41291 - DNA, 432 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcctggagacggtccagcggctgttgctggttctgtgccaggcccacggcttgaccccggagcatgtggtggccatccccagccacgatggccgagacctcaagaaagcaatcccaccgcactgcttccaacgctccatcccccgctccctctccccttcgccaccatcctctcctcctcggctccgccctctcccacctccccacagcctccttccctctcccttacctcgcctgacccctctactgggcctgccaaggctgcgtcctaacgggcgtctgggtcatagcccacgagtgcggccaccacgccttcagcgactac

SEQ ID NO: 41292 - DNA, 252 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacctcactgcttcaaacgctccatcccacgctccttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcaacgactac

SEQ ID NO: 41293 - DNA, 252 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacctcactgcttcaaacgctccatcccacgctccttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcagcgactac

SEQ ID NO: 41294 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41295 - DNA, 333 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggccggccaagcctgcgtcctaacgggcctctgggtcatagcccacgagtgcggccaccacgcctgcagcgactac

SEQ ID NO: 41296 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagtgactac

SEQ ID NO: 41297 - DNA, 333 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41298 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccatcagcgactac

SEQ ID NO: 41299 - DNA, 389 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgctggcgatggccaccacctgctggggggtcaagccgtgggcctggcacagcaccggcaacagccgcaatcccacctcactgcttcaaacgctccatccctcgctccttctcctcttcgacatcatcatctcctcctcggctcctccctctcccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41300 - DNA, 337 bp, Artificial
  Mutation in BnaC.FAD2.b introduced by TALE nuclease pair BnFAD2_T03
caggatccatgggtgcaggtggaagaatgcaagtctatcctccctccagctccaccagaaccaacaccctcaaacgcgtcccctgcgagacaccacccttaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 41301 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaataccacctcactgcttcaaacgctccatccctcgctccttctcctacctcctcttcgacatcctcgtctcctcctccctctaccacctctccacagcctacttccctctcctcccccaccctctcccttacctcgcctggcccctctaccgggcctgccaaggctgcgtcctaacgggcctctgggtcatcgcccaccagtccggcccccacgccttcagcgcctac

SEQ ID NO: 41302 - DNA, 409 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactctcgactacggcgtgatcgtggacaccacgagcatcacaaaaatcgacgctcaagtcagaggtggcgaaacccggagacctcaagaaagcaatcccacctcactgcttcaaacgctccatcccacactccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41303 - DNA, 349 bp, Artificial
  Mutation in BnaC.FAD2.b introduced by TALE nuclease pair BnFAD2_T03
caggatccatgggtgcaggtagaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41304 - DNA, 296 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgagtgcggccaccacgccttcagcgactac

SEQ ID NO: 41305 - DNA, 395 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgggtcaagccgtgggcctggcacagcaccggcaacagccgctggagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41306 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatagcccacgagtgcggccaccacgccttcagcgactac

SEQ ID NO: 41307 - DNA, 340 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaagcgcgtacggctgcggcgagcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41308 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacctacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 41309 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcatcgactac

SEQ ID NO: 41310 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaccctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 41311 - DNA, 347 bp, Artificial
  Mutation in BnaC.FAD2.b introduced by TALE nuclease pair BnFAD2_T03
caggatccatgggtgcaggtggaagaatgcaagtctctcctccctccagctccaccgaaaccaaaaccctcaaacgcgtcccctgcgagacaccacccttcactcagacctcaagaaagcaatcccacctcactgcttcaaacgctccatccctctccttctcctacctcctcttcgacatcctcgtctcctcctccctctaccacctctccacagcctacttccctctcctcccccaccctctcccttacctcgcctggcccctctactgggccggccaaggctgcgtcctaacgggcctctgggtcatcgcccacgtatgcggccaccgcgccatgagcaactac

SEQ ID NO: 41312 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgccattcactcagacctcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtccgaaccggcgtctgggtcatagcccacgagtgcggccaccacgccttcagcgactac

SEQ ID NO: 41313 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacctccattcacgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcggggtcatagcccacgagtgcggccaccacgccttcagcgactac

SEQ ID NO: 41314 - DNA, 411 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccatcaaccgcgtcccctgcgagccaccacccttcactctcgggtttttatgattagagtcccgcaattatacatttaatacgcgatagaaaacaaaatatagacctcaagaaagcaatcccaccgcactgcttcaaacgcaccatccctcgcgccttctcctacctcctcttccacacccacgtctcctccaccctctaccacctctccacaccctacgcccctctcctcccccaccctctccctttcctcgccaagcccctctactgggcctgccaagactgcttcctaacgggcctcgggttcatctctcgcaagtgctgtgtccacgccttgagcaactac

SEQ ID NO: 41315 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctggcgatggccaccaccattcactcggggggtcaagccgtgggcctggcacagcaccggcaacagccgcagacctcaagaaagcaatcccacctcactgcttcaaacgctccatccctcgcgccttctcctacctcctcttcgacatcctcgtctcctcctccctctaccacctctccacagcctgcttccctctcctcccccaccctctcccttacctcgccgggcccctctactgggccggccaaggctgcgtcctaacgggcctcggggtcatctcccacgaatgcggccaccacgccttcagcgactac

SEQ ID NO: 41316 - DNA, 336 bp, Artificial
  Mutation in BnaC.FAD2.b introduced by TALE nuclease pair BnFAD2_T03
caggatccatgggtgcaggtggaagaatgcaagtctttcctccctccagctcccccggaaccaacaccctcaaacgcgtcccctgcgagacaccaccattcacctgagacctcaagaaagcaatcccacctcactgcttcaaccgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41317 - DNA, 308 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41318 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41319 - DNA, 327 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcacccacgaatgcggccaccacgcctttagcgactac

SEQ ID NO: 41320 - DNA, 396 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccaacaccatcaagcgcgtaccctgcgagacaccgcccttcactgtcggttcagcctggtcagctgggccttgtagtttcccttgaagtggccggacacgaacaggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41321 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcctacctcactgcttcaaacgctccatcccacgccccttctcctcttcgacatcatcatctcctcctcggcgcctccctctaccacctctccacagcctccttccctctcccttacctcgcctgacccctctacggggcctgccaaggctgcgtcctaacgggcctctgggtcatagcccacgagtgcggccaccacgccttcagcgactac

SEQ ID NO: 41322 - DNA, 295 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgccagacctcaagaaagcaatcccacctcactgcttcaaacgctccatcccacgctccttctcctcttcgacatcatcatctcctcctcggctcctccctcaccctctctcctacttcgcctggcctctctactgggcctgccagggctgcgtcctaaccggcgtctgggtcatagcccacgagtgcggccaccacgccttcagcgactac

SEQ ID NO: 41323 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggagacctcaagaaagcaatcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 41324 - DNA, 318 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcataaccggcgtctgggtcatagcccacgagtgcggccgccacgccctcagcgactacc

SEQ ID NO: 41325 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttctagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41326 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgtaaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41327 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgagtgcggccaccacgccttcagcgactac

SEQ ID NO: 41328 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccccgcctggcccctctactgggcctgccaaggctgcgtcctacgggcctctgggtcatcgcccacgaatgcggccaccacgccttcagcgactac

SEQ ID NO: 41329 - DNA, 331 bp, Artificial
  Mutation in BnaC.FAD2.b introduced by TALE nuclease pair BnFAD2_T03
caggatccatgggtgcaggtggaagaatgcgagtctctcctacctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41330 - DNA, 311 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41331 - DNA, 334 bp, Artificial
  Mutation in BnaC.FAD2.b introduced by TALE nuclease pair BnFAD2_T03
caggatcatgggtgcaggtggaagaatgcaagtctctcctccctccagctcccccggaaccaacaccctcaaacgcgtcccctgcgagacaccaccattcactctcacctcaagaaagcaatcccacctcactgcttcaaacgctccatcccacgctccttctcctcttcgacatcatcatctcctcctcggctcctccctctaccacctctccacagcctacttccatctcccttacctcgcctgacccctctactgggcctgccaagggtgcgtcctaacgggcctctgggtcatagcccacgagtgcggccaccacgccttcagcgactac

SEQ ID NO: 41332 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 41333 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcctcaagaaagcaatccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41334 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcctctgggtcatcgcccacgaatgcggccaccacgccttcagcgactac

SEQ ID NO: 41335 - DNA, 265 bp, Artificial
  Mutation in BnaC.FAD2.b introduced by TALE nuclease pair BnFAD2_T03
caggatccatgggtgcaggtcgaagaatgcaagtctctcctccctccagtctctccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41336 - DNA, 336 bp, Artificial
  Mutation in BnaC.FAD2.b introduced by TALE nuclease pair BnFAD2_T03
caggatccatgggtgcaggtggaagaatgcaagtctctcctccctcccgctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 41337 - DNA, 337 bp, Artificial
  Mutation in BnaC.FAD2.b introduced by TALE nuclease pair BnFAD2_T03
caggatccatgggtgcaggtgaaagaatgcaagtctctcctccctccagctcccccggaaccaacaccctcaaacgcgtcccctgcgagacaccaccattcactctcagacctcaagaaagcaatcccacctcactgcttcaaacgctccatcccaccctccttctcctcttcgacatcatcatctcctcctcggctcctccctctaccacctctccacagcctacttccctctcccttacctcgcctgacccctctactgagcctgcctagagtgcgtcctaaccggcgtcggggtcattgcccgcaagtgctgccaccgcgccatgaacgactac

SEQ ID NO: 41338 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcgtctgggtcatagcccacgagtgcggccaccacgccttcagcgactac

SEQ ID NO: 41339 - DNA, 339 bp, Artificial
  Mutation in BnaC.FAD2.b introduced by TALE nuclease pair BnFAD2_T03
caggatccatgggtgcaggtggaagaatgcaagtatctcctccctccagctcccccgaaaccaaaaccctcaaacgcgtcccctgcgagacaccacccttcactctctcaagaaagcaatcccgcctcactgcttcaaacgctccatcccacgctccttctcctcttcgacatcatcatctcctcctccctctaccacctctccacagcctacttccctctcctccccccccctctcccttccctcgcctggcccctctacggggcctgccaaggctgcgtcctaacgggcctctgggtcatcgcccacgaatgcggccaccacgcctgcagcgactac

SEQ ID NO: 41340 - DNA, 347 bp, Artificial
  Mutation in BnaC.FAD2.b introduced by TALE nuclease pair BnFAD2_T03
caggatccatgggtgcaggtggaagaatgcaagcgtctcctccctccaagaagtctgaaaccgacaacatcaagcgcgtaccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41341 - DNA, 265 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatccctcgctccttctcctcttcgacatcatcatctcctcctcggctcctccctctaccacctctccacagcctacttccctctcccttacctctcctgacccctctactgggcctgccaagtctgcgtcctaacgggcctctgggtcatagcccacgagtgcggccaccacgccttcagcgactac

SEQ ID NO: 41342 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatcggtgacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 41343 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaacctcaagaaagcaatcccacctcactgcttcaaacgctccatcccacgctccttctcctcttcgacatcatcatctcctcctcggctcctccctctaccacctctccgcagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 41344 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41345 - DNA, 342 bp, Artificial
  Mutation in BnaC.FAD2.b introduced by TALE nuclease pair BnFAD2_T03
caggatccatgggtgcaggtggaagaatgcaagtttctcctccctccaagaagtctgaaaccgacaccatcaagcgcgtaccctgcgagacaccgccattcactcagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41346 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccaccctccttctcctcttcgacatcatcatctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 41347 - DNA, 415 bp, Artificial
  Mutation in BnaC.FAD2.b introduced by TALE nuclease pair BnFAD2_T03
caggatccatgggtgcaggtggaataatgcaagtctctcctccctccagctcccccgaaaccaaaaccctcaaacgcgtcccctgcgagacaccacccttcactctagagcggatttgtcctactcaggagagcgttcaccgacaaacaacagataaaacgaaaggctcagagacctcaagaaagcaatcccacctcactgcttcaaacgctccatccctcgctccttctcctacctcctcttcgacatcctcgtcccctcccccctctaccacctctccacagcctacttccctcccctcccccaccctctcccttacctcgcctggcccctctactgggcctgccaaggctgcgtcctaacgggcctctgggtcatcgcccacgaatgcggccaccacgccttcagcgactac

SEQ ID NO: 41348 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcggagacctcaagaaagcaatcccaccgcactgtttcaaacgctcgatccctcgctctttctcctacctcatctgggacatcatcatagcctcctgcttctactacgtcgccaccccttacttccctctcctccccccccctctcccttacctcgcctggcccctctacggggcctgccaaggctgcgtcctaacgggcctctgggtcatcgcccacgaatgcggccaccacgccttcagcgactac

SEQ ID NO: 41349 - DNA, 338 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41350 - DNA, 294 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcataggccacgagtgcggccaccacgccttcagcgactac

SEQ ID NO: 41351 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctttcctcccccaccctctcccttacctcgcctggcccctctactgggcctgccaaggctgcgtcctaacgggcctctgggtcatagcccacgagtgcggccaccacgccttcagcgactac

SEQ ID NO: 41352 - DNA, 400 bp, Artificial
  Mutation in BnaC.FAD2.b introduced by TALE nuclease pair BnFAD2_T03
cattctcccttttttcatttttaagaatgcaagtctctcctccctccagctcccccggaaccaacaccctcaaacgcgtcccctgcgagacaccaccattcactctcggggtcaagccgtgggcctggcacagcaccggcaacagccgctggaccgagacctcaagaaagcaatcccacctcactgcttcaaacgctccatcccacgctccttctcctacctcctcttcgacatcctcgtctcctcctcccgctaccacctctccacagcctacttccctctcctcccccacccgctcccttccctcgcctggcccctctactgggcctgccaaggctgcgtcctaacgggcctctgggtcatcgcccacgaatgcggaaaaaaagccttcagagactac

SEQ ID NO: 41353 - DNA, 400 bp, Artificial
  Mutation in BnaC.FAD2.b introduced by TALE nuclease pair BnFAD2_T03
cattctcccttttttcatttttaagaatgcaagtctctcctccctccagctccctcggaaccaacaccctcaaacgcgtcccctgcgagacaccaccattcattctcggggtcaagccgcgggcctggcacagcaccggcaacagccgctggaccgagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcgggaaaaaagccttcagagactaa

SEQ ID NO: 41354 - DNA, 345 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41355 - DNA, 279 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtcctaacgggcctctgggtcatcgcccacgaatgcggccaccacgccttcagcgactac

SEQ ID NO: 41356 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcgacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41357 - DNA, 365 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggttccatagcgttaaggtttcatttagcgcctcaagaaagcaatcccacctcactgcttcaaacgctccatcccacgctccttctcctcttcgacatcatcatctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 41358 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccaaagcctacttccctctcctccccccccctctctcctacttcgcctggcctctctactgggcctgccaagggtgcgtcctaaccggcgtctgggtcatagcccacgagtgcggccaccccgccttcagcgactac

SEQ ID NO: 41359 - DNA, 382 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactactgacagaaccgcaacgttgaaggagccactcagccgcgggtttctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41360 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccaaggttgcgtcctaaccggcgtctgggtcatagcccacgagtgcggccaccacgccttcagcgactac

SEQ ID NO: 41361 - DNA, 351 bp, Artificial
  Mutation in BnaC.FAD2.b introduced by TALE nuclease pair BnFAD2_T03
caggatccatgggtgcaggcggaagaatgcaagtctctcctccctccagctcccccgaaaccaaaaccctcaaacgcgtcccctgcgagacaccacccttcactggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccatcagcgactac

SEQ ID NO: 41362 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctcggcctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctgacccctctactgggcctgccaaggctgcgtcctaacgggcctctgggtcatagcccacgagtgcggccaccacgccttcagcgactac

SEQ ID NO: 41363 - DNA, 283 bp, Artificial
  Mutation in BnaC.FAD2.b introduced by TALE nuclease pair BnFAD2_T03
caggatccatgggtgcaggtggaagaatgcaagtctctcctctcggagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41364 - DNA, 417 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagatcggcgatatcgatgctgtccatgtgctgtctctcgaacttggcagcggcagtctccttatcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41365 - DNA, 367 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgagcgccatctcgaaccgacgttgctggccgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggccggccaaggctgcgtcctaacgggcctctgggtcatagcccacgagtgcggccaccacgccttcagcgactac

SEQ ID NO: 41366 - DNA, 353 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41367 - DNA, 357 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctccgccggagacctcaagaaagcaatcccacctcactgcttcaaacgctccatccctcgctccttctcctacctcctcttcgacatcctcgtctcctcctccctctaccacctctccacagcctacttccctctcctcccccaccctcgcccttacctcgcctggcccctctactgggcctgccaaggctgcgtcctaacgggcctctgggtcatagcccacgagtgcggccaccacgccttcagcgactac

SEQ ID NO: 41368 - DNA, 304 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41369 - DNA, 322 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactctccatcccacctcactgcttcaaacgctccatcccacgcgccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41370 - DNA, 324 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtccgaacgggcctctgtgtcatagcccacgagtgcggccaccacgccttcagcgactac

SEQ ID NO: 41371 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccctcagcgactac

SEQ ID NO: 41372 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactggagacctcaagaaagcaatcccacctcactgcttcaaacgctccatcccacgccccttctcctcttcgacaccatcatctcctcctcggcccctccctctaccacctctccacaccctacttccctctcccttacctcgcctgacccctctactgggcctgccaaggctgcgtcctaacgggcctctgggtcatagcccacgagtgcggccaccacgccttcagcgactac

SEQ ID NO: 41373 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccttcaaacgcgtcccctgcgagacaccaccattcactggagacctcaaaaaagaaatcccacctcactgcttcaaaccctccaccccacgctccttctcctcttcgacatcatcatctcctccccggctcctccccctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41374 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgaccacaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41375 - DNA, 370 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggtggataaccgtattaccgcctttgagtgagctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41376 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgaggcaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctcggggtcatagcccacgagtgcggccaccacgccttcagcgactac

SEQ ID NO: 41377 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggatgcttcctaacgggcctctgggtcatcgcccacgaatgcggccaccacgccttcagctactac

SEQ ID NO: 41378 - DNA, 411 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagttgccggtgctgtgccaggcccacggcttgaccccccagcaggtggtggccatcgccagcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41379 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctggcccctctactgggcctgccaaggctgcgtcctaacgggcctctgggtcatcgcccacgaatgcggccaccacgccatcagcgactac

SEQ ID NO: 41380 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaccgcgtcccctgcgagacaccaccattcactctagacctcaagaaagcaattccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcggggtcatagcccacgagtgcggccaccacgccttcagcgactac

SEQ ID NO: 41381 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctctgggtcatagcccacgtgtgcggccaccacgccttcagcgactac

SEQ ID NO: 41382 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaactaacaccctcaaacgcgtcccctgcgagacaccaccattcaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41383 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41384 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattagacctcaagaaagcaatcccacctcactgcttcaaacgctccatcccacgctccttctcctcttcaacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41385 - DNA, 280 bp, Artificial
  Mutation in BnaC.FAD2.b introduced by TALE nuclease pair BnFAD2_T03
caggatccatgggtgcaggtggaagaatgcaagtctctcctccctccagtctctccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccatcagcgactac

SEQ ID NO: 41386 - DNA, 280 bp, Artificial
  Mutation in BnaC.FAD2.b introduced by TALE nuclease pair BnFAD2_T03
caggatccatgggtgcaggtggaagaatgcaagtctctcctccctccagtctctccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41387 - DNA, 410 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcagcggatttgtcctactcaggagagcgttcaccgacaaacaacagataaaacgaaaggcccagtcttccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgaatgcggccaccacgccttcagcgactac

SEQ ID NO: 41388 - DNA, 329 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctcggaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 41389 - DNA, 417 bp, Artificial
  Mutation in BnaC.FAD2.b introduced by TALE nuclease pair BnFAD2_T03
caggatccatgggtgtaggtggaagaatgcaagtctctcctccctccagctcccccggaaccaacaccctcaaacgcgtcccctgcgagacaccaccattcactctcggctgttgccggtgctgtgccaggcccacggcttgaccccggagcaggtggtggccatcgccagccacgatggcggcaagagacctcaagaaagcaatcccacctcactgcttcaaacgctccatcccacgctccttctcctcttcgacatcatcatctcctcctcggctcctccctctaccacctctccacagcctccttccctctcccttacctcgcctgccccctctactgggcctgccaaggctgcgtcctaacgggcctctgggtcatagcccacgagttcggccaccacgccttcagcgactac

SEQ ID NO: 41390 - DNA, 417 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctgttgccggtgctgtgccaggcccacggcttgaccccggagcaggtggtggccatcgccagccacgatggcggcaagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagttcggccaccacgccttcagcgactac

SEQ ID NO: 41391 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 41392 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaaagacctcaagaaagaaaccccacctcactgcttcaaacgccccaacccacgctccttctcctcttcgacatcatcatctcctcctctgctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 41393 - DNA, 337 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacaacaagcgcgtaccctgcgagacaccgcccttcactgtgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41394 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgcttcaaacgctccatcccacgctccttctcctcttcgacatcatcatctcctcctcggctcctccctctaccacctctccacagcctacttcactctcccttacctcgcctgacccctctactgggcctgccaaggctgcgtcctaacgggcctctgggtcatcgcccacgaatgcggccaccacgccttcagcgactac

SEQ ID NO: 41395 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgacctcaagaaagcaatcccaccacactgcttcaaacgctccatcccacgatccttctcctcttcgacatcatcatcacctcctcggctactccctctaccacctctccacagactacttccctctcccttacctcgcctggcccctctactgggcctgccaaggctgcgtcctaacgggcctctgggtcatagcccacgagtgcggccaccacgccttcagcgactac

SEQ ID NO: 41396 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 41397 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccatcaaacgcgtcccctgcgagacaccaccattcactctcagacctcaagagagcaatcccacctcactgcttcaaacactccatcccacgctccttctcctcttccacatcatcatcacctcctcggctcctccctctaccacctctccacagcctacttccctctcccttacctcgcctgacccctctactgggcctgccagggctgcgtcctaacgggcgtctgggtcatagcccacgagtgcggccaccacgccttcagcgactac

SEQ ID NO: 41398 - DNA, 309 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41399 - DNA, 335 bp, Artificial
  Mutation in BnaC.FAD2.b introduced by TALE nuclease pair BnFAD2_T03
caggatccatgggtgcaggtggaagaatgcaagtccctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 41400 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtcggggtcatagcccacgagtgcggccaccacgccttcagcgactac

SEQ ID NO: 41401 - DNA, 345 bp, Artificial
  Mutation in BnaC.FAD2.b introduced by TALE nuclease pair BnFAD2_T03
caggatccatggtgcaggtggaagaatgcaagtctctcctccctccagctcccccgaaaccaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41402 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcagaacgggcctctgggtcatagcccacgagtgcggccaccacgccttcagcgactac

SEQ ID NO: 41403 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41404 - DNA, 463 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgggtggcaagcaggcgctggagacggtccagcggctgtttgccaccaatattgctggcgatggccaccacctgctccggggtcaagccgtgggcctggcacagcaccggcggagaactcaagaaagcaatcccaccgcactgtttcaaacgctcgatcccccgctccttctcctacctcccctccgacatcctcgtctcctcctccctctaccacccctccccagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 41405 - DNA, 346 bp, Artificial
  Mutation in BnaC.FAD2.b introduced by TALE nuclease pair BnFAD2_T03
caggatccatgggtgcaggtggaagaatgcaagtctctcctccctcccgctcccccggaaccaacaccctcaaacgcgtcccctgcgagacaccaccattcacttcctcaagaaagcaatcccacctcactgcttcaaacgctccatccctctctccttctcctacctcctcttcgacatcctcttctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41406 - DNA, 327 bp, Artificial
  Mutation in BnaC.FAD2.b introduced by TALE nuclease pair BnFAD2_T03
caggatccattggtgcaggtggaagaatgcaagtctctcctccctccagctcccccgaaaccaaaaccctcaaacgcgtcccctgcgagacaccaccagtcctccagaaagcactcccacctccctgcttcaaacgctccttccctcgctccttctcctcttcgacatcgtcatctcctcctcgcctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 41407 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagcctgcgtcctaacgggcctctgggtcatctcccacgaatgctgccaccacgccttcagcgactac

SEQ ID NO: 41408 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgccctagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 41409 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctcctagacaccaccattcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttgagcgactac

SEQ ID NO: 41410 - DNA, 334 bp, Artificial
  Mutation in BnaC.FAD2.b introduced by TALE nuclease pair BnFAD2_T03
caggatccatgggtgcaggtgcaagaatgcaagtctctcctccctcccgctcccccggaaccaacaccctcaaacgcgtcccctgcgagacaccaccattcactctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctctgggtgatagcccgcgagtgcggccacctcgccttcatcgactac

SEQ ID NO: 41411 - DNA, 344 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41412 - DNA, 310 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41413 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41414 - DNA, 354 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcggccacgaatgcggccaccacgccttcagcgactac

SEQ ID NO: 41415 - DNA, 399 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcgaacgcgtcccctgcgagacaccacccataccggccaccacctgctggggggtcaagccgtgggcctggcacagcaccggcaacagccgctggaccggagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccgcgccttcagcgactac

SEQ ID NO: 41416 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcatcgactac

SEQ ID NO: 41417 - DNA, 351 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 41418 - DNA, 337 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacaaatgcggccaccacgccttcagcgactac

SEQ ID NO: 41419 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttgcctcgcctggcccctctactgggcctgccaaggctgcgtcctaacgggcctctgggtcatcgcccacgaatgcggccaccacgccttcagcgactac

SEQ ID NO: 41420 - DNA, 334 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccaccattcactagacctcaagaaagcaatcccacctcactgcttcaaacgctccatccctcgctccttctcctcttcgacatcatcatctcctcctcggctcctccctctaccacctctccacagcctacttccctctcccttacctcccctgacccctctactgggccggcctaggctacgtctgaatgggcctcggggtcatatcttgcatgtgctgtgaccgcgccatgaacaactac

SEQ ID NO: 41421 - DNA, 328 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttaactcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 41422 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgattgcggccaccacgccttcagcgactac

SEQ ID NO: 41423 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaagggtgcgtcctaaccggcgtctgggtcatcgcccacgaatgcggccaccacgccttcagcgactac

SEQ ID NO: 41424 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 41425 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactggacctgccaaggctgcgtcctaacgggcctctgggtcatcgcccacgaatgcggccaccacgccttcagcgactac

SEQ ID NO: 41426 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacaggcccacggcttgaccccccagcaggtggtggccatcgccagcaataatggtggcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41427 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgccatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41428 - DNA, 338 bp, Artificial
  Mutation in BnaC.FAD2.b introduced by TALE nuclease pair BnFAD2_T03
caggtccatgggtgcaggtggaagaatgcaagtctctcctccctccagctcccccgaaaccaaaaccctcaaacgcgtcccctgcgagacaccaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 41429 - DNA, 418 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccgcccttcactccagcggctgttgccggtgctgtgccaggtccacggcttgaccccggagcaggtggtggccatcgccagccacgatggcggtggagaactcaagaaagcaatcccacctcactgcttcaaacgctccatcccacgctccttctcctcttcgacaccatcatcccctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 41430 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaacaccatcaacatcgtggctggcgatggccaccacctgtgccaggcccacctcaagaaagcaatcccacctcactgcttcaaacgctccatcccacgctccttctcctcttcgacatcatcatctcctcctcggctcctccctcaccctctctcctacttcgcctggcctctctactgggcctgccagggctgcgtcctaaccggcgtctgggtcatagcccacgagtgcggccaccacgccttcagcgactac

SEQ ID NO: 41431 - DNA, 307 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccatcccacgctccttctcctacctcctcttcgacatcctcgtctcctcctccctctaccacctctccacagcctacttccctctcctcccccaccctctcccttacctcgcctgacccctctactgggcctgccaaggctgcgtcctaacggacctctgggtcatcgcccacgagtgcggccaccacgccttcagcgactac

SEQ ID NO: 41432 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgcgacaccaccattcactctagacctcaagaaagcaatcccacctcactgcttcaaacgctccatcccacgctccttctcctcttcgacatcatcatctcctcctcggctcctccctctaccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 41433 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctccttctccctctactacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41434 - DNA, 336 bp, Artificial
  Mutation in BnaC.FAD2.b introduced by TALE nuclease pair BnFAD2_T03
caggatccatgggtgcaggcggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatcccacgctccttctcctcttcgacatcatcatctcctcctcggctcctccatctaccacctctccacagcctacttccctctcccttacctcgcctgacccctctactgggcctgccaaggctgcgtcctaacgggcctcggggtcatagcccacgagtgcggccaccacgccttcagcgactac

SEQ ID NO: 41435 - DNA, 317 bp, Artificial
  Mutation in BnaC.FAD2.b introduced by TALE nuclease pair BnFAD2_T03
caggatccatgggtgcaggtggaagaatgcaagtctctcctccctacagctcccccgaaaccaaaaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctaacccctctactgggcctgccaaggctgcgtcctaacgggcctctgggtcatagcccacgtgtgcggccaccgcgccttcagcgactac

SEQ ID NO: 41436 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaacgggcctctgggtcatcgcccacgaatgcggccaccacgccttcagcgactac

SEQ ID NO: 41437 - DNA, 280 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccacctcactgcttctaacgctccatccctcgctccttctcctacctcctcttcgacatcctcgtctcctcctccctctaccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 41438 - DNA, 459 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgtctccagcggctgttgccggtgctgtgccaggcccacggcttgaccctcagcaggtggtggccatcgccagcaatggcggtggcaagcaggcgctggagacggtccagcggagaactcaagaaagcaatcccacctccctgctccaaacgctccatccctcgctccttctcctacctcctcttcgacatcctcgtctccccctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagccactac

SEQ ID NO: 41439 - DNA, 336 bp, Artificial
  Mutation in BnaC.FAD2.b introduced by TALE nuclease pair BnFAD2_T03
caggatccatgggtgcaggtgaaagaatgcaagtctctcctccctccagctcccccggaaccaacaccctcaaacgcgtcccctgcgagaaaccaccattcactcttgacctcaagaaagcaatcccacctcactgcttcaaacgctccatccctcgctccttctcctcttcgacatcaccatctcctcctcggctcctccctctaccacctctccacagcctacttccctctcccttccctcgcctggcccctctactgggcctgccaaggctgcgtcctaacgggcctctgggtcatagctcacgagtgcggccaccacgccttcagcgactac

SEQ ID NO: 41440 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgacctcaagaaagcaatcccacctcactgcttcaaacgctccatccctcgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 41441 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacatcctacttccctctcctcccccaccctctcccttacctcgcctggcccctctactgggcctgccaaggctgcgtcctaacgggcctctgggtcatcgcccacgaatgcggccacctcgccgtcagcgactac

SEQ ID NO: 41442 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaagtctgcttcctagcgggcgtctgggtcatcgcccacgaatgcggccaccacgccttcagcgactac

SEQ ID NO: 41443 - DNA, 387 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgaccccggagcaggtggtggccatcgccagccacgatggcggcaagcaggcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41444 - DNA, 349 bp, Artificial
  Mutation in BnaC.FAD2.b introduced by TALE nuclease pair BnFAD2_T03
caggatccatgggtgcaggtggaagaatgcaagtctctcctccctccaactcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccactaatgcggccaccacgccttcagcgactac

SEQ ID NO: 41445 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 41446 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 41447 - DNA, 406 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaaagactgggcctttcgttttatctgttgtttgtcggtgaacgctctcctgagtaggacaaatccgccggagacctcaagaaagcaatcccacctcactgcttcaaacgctccatcccacgctccttctcctcttcgacatcatcacctcctcctcggctcctccctctcccacccctccacagcctacttccctctccctttcctcgcctgccccctctactgggccggccaaggctgcgtcctaacgggcctctgggtcatagcccacgagtgcggccaccacgccttgagcgactac

SEQ ID NO: 41448 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctatactgggcctgccaaggctgcgtcctaacgggcctcggggtcatcgcccacgaatgcggccaccacgccttcagcgactac

SEQ ID NO: 41449 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactcgagacctcaagaaagcaatcccacctcactgcttcaaacgctccatcccacgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccgcgccatcagcgactac

SEQ ID NO: 41450 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgtggccaccacgccttcagcgactac

SEQ ID NO: 41451 - DNA, 425 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtcgttcggctgcggcgagcggtatcagctcactcaaaggcggtaatacggttatcacctgtcgcaaatatagtaaaacacttatagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41452 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaccgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctcgcccttacctcgcctggcccctctactaggccggccaaggctgcgtccgaacgggcctctgggtcatcgcccacgaatgcggccaccgcgccatcagcgactac

SEQ ID NO: 41453 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtatcatcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41454 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccccccactgggcctgccaaggctgcgtcctaacgggcctctgggtcatagcccacgagtgcagccaccacgccttcagcgactac

SEQ ID NO: 41455 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccaaaaccaaaaccttcaaccccctcccctgcgagacacccccaagacctcaagaaagcaatcccacctcactgcttcaaacgctccatcccacgctccttctcctcttcgacaccatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41456 - DNA, 335 bp, Artificial
  Mutation in BnaC.FAD2.b introduced by TALE nuclease pair BnFAD2_T03
cagggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41457 - DNA, 350 bp, Artificial
  Mutation in BnaC.FAD2.b introduced by TALE nuclease pair BnFAD2_T03
caggatccgtgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41458 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaattcggccaccacgccttcagcgactac

SEQ ID NO: 41459 - DNA, 356 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgacggagaactcaagaaagcaatcccaccgaactgtttcaaacgctccatccctcgctccttctcctacctcctcttcgacatcctcgtctcctcctccctctaccacctctccacagcctacttccctctcctcccccaccctctcccttacctcccctggcccctctactgggcctgccaaggctgcgtcctaacgggcctctgggtcatcgcccacgaatgcggccaccacgccttcagcgactac

SEQ ID NO: 41460 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgccccctgcgagacaccacccttcacgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41461 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacatcacccttcactcagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 41462 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgccatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 41463 - DNA, 336 bp, Artificial
  Mutation in BnaC.FAD2.b introduced by TALE nuclease pair BnFAD2_T03
caggatccatgggtgcaggtggaagaatgcaagtctctcctccccccagctcccccggaaccaacaccctcaaacgcgtcccctgcgagacaccaccattcactctagacctcaagaaaccaatcccacctcactgcttcaaacgctccatcccaccctccttctcctcttcgccatcatcatctcctcctcggctcctccctctaccacctctccacagcctacttccctctcccttacctcgcctggcccctctactgggcctgccaaggctgcgtcctaacgggcctctgggtcatcgcccacgagtgcggccaccacgccttcagcgactac

SEQ ID NO: 41464 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccatcaaacgcgtcccctgcgagacaccaccattcactctaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggatgcgtcctaacgggcctctgggtcatagcccacgagtgcggccaccacgccttcagcgactac

SEQ ID NO: 41465 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccatcagcgactac

SEQ ID NO: 41466 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctcggggtcatagcccacgagtgcggccaccacgccttcagcgactac

SEQ ID NO: 41467 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcatcccctgcgagacctcaagaaagcaatcccacctcactgcttcaaacgctccatccctcgctccttctcctcttcgacaccatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41468 - DNA, 334 bp, Artificial
  Mutation in BnaC.FAD2.b introduced by TALE nuclease pair BnFAD2_T03
caggatccatgggtgcagggggaagaatgcaagtctctcctccctccagctcccccggaaccaacaccctcaaacgcgtcccctgcgagacaccaccattcactcgacctcaagaaagcaatcccacctcactgcttcaaacgctccatcccacgccccttctcctcttcgacaccatcatctcctcctcggctcctccctctaccacctccccacagcctactcccctctcccttacctcgcctgacccctctactgggcctgccaaggctgcgtcctaacgggcctctgggtcatagcccacgagtgcggccaccacgccttcagcgactac

SEQ ID NO: 41469 - DNA, 344 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41470 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactcttacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41471 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgcgacaccaccattcactgagacctcaagaacgcaatcccacctcactgcttcaaacgctccatccctcgctccttctcctacctcctcttcgacatcctcatctcctcctccctctaccacctctccacagcctacttccctctccccccccaccctctcccttacctcgcctggcccctctactgggcctgccaaggctgcgtcctaacgggcctctgggtcatagcccacgagtgcggccaccacgccttcagcgactac

SEQ ID NO: 41472 - DNA, 406 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtccgactgggcctttcgttttatctgttgtttgtcggtgaacgctctcctgagtaggagaactcaagaaagcaatcccaccgcactgtttcaaacgctcgatccctcgctctttctcctacctcctcttcgacatcctcgtctcctcctccctctaccacccctccacagcctacttccctctccccccccaccctctcccttacctcgcctggcccctctactgggccggccaaggctgcgtcctaacgggcctctgggtcatcgcccacgaatgcggccaccacgccttcagcgactac

SEQ ID NO: 41473 - DNA, 381 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgggtcaagccgtgggcctggcacagcaccggcaacagccgctggagagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41474 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttcccactcctcccccaccctctcccttacctcgcctggcctctctactgggcctgccaaggctgcgtcctaacgggcctctgggtcatcgcccacgaatgcggccaccacgccttcagcgactac

SEQ ID NO: 41475 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 41476 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgtagagaaagcaatcccacctcactgcttcaaactctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41477 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctccattacctcgcctgacccctctactgggcctgccaaggctgcgtcctaacgggcctctgggtcatagcccacgagtgcggccaccacgccttcagcgactac

SEQ ID NO: 41478 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctacaagacctcaagaaagcaatcccacctcactgcttcaaacgctccatcccacgctccttctcctcttcgacatcatcatctcctcctcgcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41479 - DNA, 334 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacttcgcctggcctctctactgggcctgccagggctgcgtcctaaccggcgtctgggtcatagcccacgagtgcggccaccacgccttcagcgactac

SEQ ID NO: 41480 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaactcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 41481 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagccgacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41482 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctacgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccagggctgcgtcctaaccggcgtctgggtcatagcccacgagtgcggccaccacgccttcagcgactac

SEQ ID NO: 41483 - DNA, 282 bp, Artificial
  Mutation in BnaC.FAD2.b introduced by TALE nuclease pair BnFAD2_T03
caggatccatgggtgcaggtggaagaatgcaagtctctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctgacccctctactgggcctgccaaggctgcgtcctaacgggcctctgggtcatagcccacgagtgcggccaccacgccttcagcgactac

SEQ ID NO: 41484 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttcggagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctcttggtcatcgcccacgaatgcggccaccacgccttcagcgactac

SEQ ID NO: 41485 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgctcacgaatgcggccaccacgccttcagcgactac

SEQ ID NO: 41486 - DNA, 334 bp, Artificial
  Mutation in BnaC.FAD2.b introduced by TALE nuclease pair BnFAD2_T03
caggatccatgggtgcaggtggaagaatgcgagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41487 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttccacatcctcgtctcctcctccctctaccacctctccaccgcctacctccctctcccttacctcgcctggcccctctactgggcctgccaaggctgcgtcctaacgggcctctgggtcatagcccacgagtgcggccaccacgccttcagcgactac

SEQ ID NO: 41488 - DNA, 336 bp, Artificial
  Mutation in BnaC.FAD2.b introduced by TALE nuclease pair BnFAD2_T03
caggatccatgggtgcaggttgaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41489 - DNA, 348 bp, Artificial
  Mutation in BnaC.FAD2.b introduced by TALE nuclease pair BnFAD2_T03
caggatccatgggtgcaggtggaagaatgcaagtctctccaccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccgggcccctctactgggcctgccaaggctgcgtcctaacgggcctctgggtcatcgcccacgaatgcggccaccacgcctttagcgactac

SEQ ID NO: 41490 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccaccctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41491 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggccggccaaggctgcgtcctaacgggcctctgggtcatcgcccacgaatgcggccaccacgccttcagcgactac

SEQ ID NO: 41492 - DNA, 410 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcagcggatttgtcctactcaggagagcgttcaccgacaaacaacagataaaacgaaaggcccagtcttccctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcctctctactgggcctgccaagggtgcgtcctaaccggcgtctgggtcatagcccacgaatgcggccacctcgccttcagccactac

SEQ ID NO: 41493 - DNA, 349 bp, Artificial
  Mutation in BnaC.FAD2.b introduced by TALE nuclease pair BnFAD2_T03
caggatccatgggtgcaggtggaagaatgcaagtgtctcctccctcccagaagtctgaaaccgacaacatcaagcgcgtaccctgcgagacaccgcccttcactgagaactcaagaaagcaatcccaccgcactgtttcaaacgctcgatccctcgctctttctcctacctcctcttcgacatcctcgtctcctcctccctctaccacctatccacagcctacttccctctcctcccccaccctctcccttacctcgcctggcccctctactgggcctgccaaggctgcgtcctaacgggcctctgggtcatcgtccacgaatgtggccaccacgccttcagcgactac

SEQ ID NO: 41494 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttacctcaagaaagcaatcccacctcactgcttcaaacgctccatcccacgctccttctcctcttcgacatcatcatctcctcctcggctcctccctctaccacctctccacagcctacttccctctcccttccctcgcctgacccctctacggggcctgccaaggctgcgtcctaacgggcctcggggtcatagcccacgagtgcggccaccacgccttcagcgactac

SEQ ID NO: 41495 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttacctcaagaaagcaatcccacctcactacttcaaacgctccatcccacgctccttctcctcttcgacatcatcatctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 41496 - DNA, 336 bp, Artificial
  Mutation in BnaC.FAD2.b introduced by TALE nuclease pair BnFAD2_T03
caggatccatggggtgcaggtggaagaatgcaagtctctcctccctccagctcccccgaaaccaaaaccctcaaacgcgtcccctgcgagacacacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41497 - DNA, 330 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaccgcgtcccctgcgagacaccacccttagacctcaagaaagcaatcccacctcactgcttcaaacgctccatcccacgctccttctcctctacgacatcatcatctcctcctcggctcctccctctaccacctctccacagcctacttccctctcccttacctcgcctgacccctctactgggcctgccaaggctgcgtcctaacgggcctcggggtcatagcccacgagtgcggccaccacgccttcagcgactac

SEQ ID NO: 41498 - DNA, 319 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 41499 - DNA, 356 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41500 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcatcccccaccctctcccttacctcgcctggcccctctactgggcctgccaaggctgcgtcctaacgggcctctgggtcatcgcccacgaatgcggccaccacgccttcagcgactac

SEQ ID NO: 41501 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagcctgcttcctaacgggcctctgggtcatagcccacgagtgctgccaccacgccatcagcgactac

SEQ ID NO: 41502 - DNA, 337 bp, Artificial
  Mutation in BnaC.FAD2.b introduced by TALE nuclease pair BnFAD2_T03
caggatccatgggtgcaggtagaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaactggcctctgggtcatagcccacgagtgcggccaccgcgccttcaacgactac

SEQ ID NO: 41503 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggcttcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41504 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcactctcggcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41505 - DNA, 336 bp, Artificial
  Mutation in BnaC.FAD2.b introduced by TALE nuclease pair BnFAD2_T03
caggatccatgggtgcaggtgcaagaatgcaagtctctcctccctccagctcccccggaaccaacaccctcaaacgcgtcccctgcgagacaccaccattcactctcaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgattgcggccaccacgccttcagcgactac

SEQ ID NO: 41506 - DNA, 317 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41507 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggccggccaaggctgcgtcctaacgggcctctgggtcatagcccacgagtgcggccaccacgccttcagcgactac

SEQ ID NO: 41508 - DNA, 317 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccatacctcgcctgacccctctactgggcctgccaaggctgcgtcctaacgggcctctgggtcatagcccacgagtgcggccaccacgccttcagcgactac

SEQ ID NO: 41509 - DNA, 342 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41510 - DNA, 431 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctgttgccggtgctgtgccaggcccacggcttgaccccccagcaggtggtggccatcgccagcaatggcggtggcaagcaggcgctggagacggacctcaagaaagcaatcccacctcactgcttcaaacgctccatcccacgctccttctcctctccgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41511 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacctacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 41512 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 41513 - DNA, 332 bp, Artificial
  Mutation in BnaC.FAD2.b introduced by TALE nuclease pair BnFAD2_T03
caggatccatggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41514 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgaatgcggccaccacgccttcagcgactac

SEQ ID NO: 41515 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccatcaaacgcgtcccctgcgagacaccacccttcactacctcaagaaagcaaacccacctcactgcttcaaacgctcaatccctcgttccttctcctacctcctctccgacatcctcgtttcctcctccctctaccacctccccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 41516 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttggagacctcaagaaagcaatcccacctcactgcttcaaacgctccatccctcgctccttctcctcttcgacatcatcctctcctcctcggctcctccctctaccacctctccacagcctacttccctctcccttacctcgcctgacccctctactgggcctgccaaggctgcgtcctaactggcctctgggtcatagcccacgagtgcggccaccacgccttcagcgactac

SEQ ID NO: 41517 - DNA, 377 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcgctcggtcgttcggctgcggcgagcggtagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41518 - DNA, 406 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacgctcaagtcagaggtggcgaaacccgacaggactataaagataccaggcgttagacctcaagaaagcaatcccacctcactgcttcaaacgctccatccctcgctccttctcctacctcctcttcgacatcctcgtcgcctcccccctctcccacctctccccagcctccttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 41519 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacggagacctcaagaaagcaatcccacctcactgcttcaaacgctccatccctcgctccttctcctacctcctcttcgacatcctcgtctcctcctccctctaccacctctccacagcctacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 41520 - DNA, 291 bp, Artificial
  Mutation in BnaC.FAD2.b introduced by TALE nuclease pair BnFAD2_T03
caggatccatgggtgcaggtggaagaatgcaagtctctcctctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41521 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactaaagcaatcctacctcacttcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 41522 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctaccaagggtgcgtcctaacgggcctctgggtcatcgcccacgaatgcggccaccacgccttcagcgactac

SEQ ID NO: 41523 - DNA, 407 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgggcctggcacagcaccggcaacagccgctggaccgtctccagcgcctgcttgcgagacctcaagaaagcaatcccaccccactgcttcaaacgctccatcccaccctccttctcctcttcgacatcatcatctcctcctcggctcctccctctacccccgctccacagcctacttccctctcctcccccaccctctcccttacctcgcctggcccctctactgggcctgccaaggctgcgtccgaacgggcctctgggtcatcgcccacgaatgcggccaccacgccttcagcgactac

SEQ ID NO: 41524 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagaccccaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41525 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccgcgccttcagcgactac

SEQ ID NO: 41526 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagccaccaccattcactcgacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41527 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggactctgggtcatagcccacgagtgcggccaccacgccttcagcgactac

SEQ ID NO: 41528 - DNA, 349 bp, Artificial
  Mutation in BnaC.FAD2.b introduced by TALE nuclease pair BnFAD2_T03
caggatccatgggtgcaggtggaggaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41529 - DNA, 352 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41530 - DNA, 279 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactcttcgacatcctcgtctcctcctccctctaccacctctccacagcctacttccctctcctcccccaccctctcccttacctcgcctggcccctctactgggcctgccaaggctgcgtcctaacgggcctcggggtcatagcccacgagtgcggccaccacgccttcatcgactac

SEQ ID NO: 41531 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccgtcagcgactac

SEQ ID NO: 41532 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccttagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41533 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaacgctccatccctcgctccttctcctacctcctcttcgacatcctcgtctcctcctccctctaccacctctccatagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41534 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgcgcctggcccctctactgggcctgccaaggctgcgtcctaacgggcctctgggtcatcgcccacgaatgcggccaccacgccttcagcgacta

SEQ ID NO: 41535 - DNA, 328 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacctcaagcgcgtcccctgcgagacaccaccaagacctcaagaaagcaatcccacctcactgcttcaaacgctccatcccacgctccttctcatcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41536 - DNA, 394 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcgttcaaatccgctcccggcggatttgtcctactcaggtgaacgagacctcaagaaagcaatcccacctcactgcttcaaacgctccatccctcgctccttctcctacctcctcttcgccatcctcgactcctcctccctctaccacctctccacgtcctacttccctctccgccccccccctctccctttcctcgcctggcccctctactgggccggccaaggctgcgtcctagcgggcctctgggtcatcgccctcgaaggcggccaccacgccttcagcgactac

SEQ ID NO: 41537 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtccgaacgggcctctgggtcatagcccacgagtgcggccaccacgccatcagcgactac

SEQ ID NO: 41538 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactagaactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41539 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccacccttcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41540 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctacctcctcttcgacatcatcatctcctcctcggctcctccctctaccacctctccacagcctacttccctctcccttacctcgcctgacccctctactgggcctgccaaggctgcgtccgaacgggcctctgggtcatagcccacgagtgcggccaccacgccttcagcgactac

SEQ ID NO: 41541 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 41542 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41543 - DNA, 335 bp, Artificial
  Mutation in BnaC.FAD2.b introduced by TALE nuclease pair BnFAD2_T03
caggatccatgggtgcaggtggaagaatgcaagtctctcctccctccaactcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41544 - DNA, 328 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccacccttcactcaagaaagcaatcccacctcactgcttcaaacgctccatcccacgctccttctcctcatcgacatcatcatctcctcctcggctcctccctctaccacctctccacagcctacttccctctcccttacctcgcctggcccctctactgggcctgccaaggctgcgtcctaacgggcctctgggtcatcgcccacgagtgcggccaccacgccttcagcgactac

SEQ ID NO: 41545 - DNA, 303 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgtgtcccctgcgagacaccacctcactgcttcaaacgctccatctcacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 41546 - DNA, 347 bp, Artificial
  Mutation in BnaC.FAD2.b introduced by TALE nuclease pair BnFAD2_T03
caggatccatgggtgcaggtggaagaatgcaagtctctcctccatccagctcccccgaaaccaaaaccctcaaacgcgtcccctgcgagacaccacccttcactcgcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41547 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagacctcaagaaagcaatcccacctcactgcttcaaacgctccatcccccgctccttctcctacctcctcttcgacatcctcgtctcctcctccctctaccacctctccacagcctacttccctctcctcccccaccctctcccttgcctcgcctggcccctctactgggcctgccaagggtgcgtcctaaccggcgtctgggtcatagcccacgagtgcggccaccacgccttcagcgactac

SEQ ID NO: 41548 - DNA, 335 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41549 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcacccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41550 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaccgcgtcccctgccagacaccacccttcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacggtcctcggggtcattgcccacgagtgcggccaccccgccttcagcgactac

SEQ ID NO: 41551 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggcctcaagaaagcaatcccacctcactacttcaaacgctccatccctcgctccttctcctacctcctcttcgacatcctcgtctcctcctccctctaccacctctccacagcctacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 41552 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacacacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcggggtcatcgcccacgaatgcggccaccacgccttcagcgactac

SEQ ID NO: 41553 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41554 - DNA, 342 bp, Artificial
  Mutation in BnaC.FAD2.b introduced by TALE nuclease pair BnFAD2_T03
caggatccatgggtgcaggtggaagaatgcaagtttctcctccctcccgctcccccgaaaccaaaacactcaaccgcgtcccctgcgaaacaccacccttcactcaagaaagcaatcccacctcactgcttcaaacgctccatccctcgctccttctcctacctcctcttcgacatccttgtctcctcctccctctaccacctctccacagcctacttccctctcctcccccaccctctcccttacctcgcctggcccctctactgggcctgccaatgctgcgtcctaacgggcctctgggtcatcgcccacgaatgctgccaccgcgccatcagcgactac

SEQ ID NO: 41555 - DNA, 257 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaccgcgtcccctgcgagacaccaccattcactctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41556 - DNA, 357 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41557 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactggacctgccaaggctgcgtcctaacgggcctctgggtcatagcccacgattgcggccaccacgccttcagcgactac

SEQ ID NO: 41558 - DNA, 382 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctctgagcctttcgttttatctgttgtttgtcggtgaacgctctcctgagacctcaagaaagcaatcccacctcactgcttcaaacgctccatccctcgctccttctcctcttcgacatcatcatctcctcctcggctcctccctctcccacctctccacagcctacttccctctcccttgcctcgcctgacccctctactgggcctgccaaggctgcgtcctaacgggcctcggggtcatcgcccacgaatgcggccaccacgccttcagcgactac

SEQ ID NO: 41559 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41560 - DNA, 420 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgccggtgctgtgccaggcccacggcttgaccccccagcaggtggtggccattgccagcaatggcggtggagacctcaagaaagcaatcccacctcactgcttcaaacgctccatccctcgctccttctcctacctcctcttcgacatccgcgtctcctcctccccctaccacctctccacagcctacttccctctccgccctcaccctctctcctacttcgcctggcctctctactgggcctgccaagggtgcgtcctaaccggcgtctgggtcatagcccacgagtgcggccaccacgccttcagcgactac

SEQ ID NO: 41561 - DNA, 420 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgccggtgctgtgccaggcccacggcttgaccccccagcaggtggtggccatcgccagcaatggcggtggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 41562 - DNA, 315 bp, Artificial
  Mutation in BnaC.FAD2.b introduced by TALE nuclease pair BnFAD2_T03
caggatccatgggtgcaggtggaagaatgcaagtctctcctccctcccgtccccccggaaacaacaccctcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41563 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 41564 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaacctcaaacgcgttccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41565 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacacacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccgcgccttcagcgactac

SEQ ID NO: 41566 - DNA, 334 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41567 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccaccgcactgtttcaaacgctcgatccctcgctctttctcctacctcatctgggacatcatcatagcctcctcggctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 41568 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtactcaagaaagcaatcccaccgcactgtttcaaacgctcgatcccacgctccttctcctcttcgacatcatcatctcctcctcggctcctccctctaccacctctccacagcctacttccctctcccttacctcgcctggaccctctactgggcctgccaaggctgcgtcctaacgggcctctgggtcatcgcccacgaatgcggccaccacgccttcagcgactac

SEQ ID NO: 41569 - DNA, 330 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttgagaactcaagaaagcaatcccaccgcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41570 - DNA, 338 bp, Artificial
  Mutation in BnaC.FAD2.b introduced by TALE nuclease pair BnFAD2_T03
caggatccatgggtgcaggtggaagaatgcaagtctctcctacctccagctcccccgaaaccaaaaccctcaaacgcgtcccctgcgagacaccacccttcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41571 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctctgggtcatagcccacgagtgcggccaccacgccttcagctactac

SEQ ID NO: 41572 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcctcccccaccctatcccttacctcgcctggcccctctactgggcctgccaaggctgcgtcctaacgggcctctgggtcatcgcccacgaatgcggccaccacgccttcagcgactac

SEQ ID NO: 41573 - DNA, 346 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgtgacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcacta

SEQ ID NO: 41574 - DNA, 334 bp, Artificial
  Mutation in BnaC.FAD2.b introduced by TALE nuclease pair BnFAD2_T03
caggatccatgggtgcaggtggaagaatgcaagtctctcctccctccagctccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 41575 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgtggccaccacgccatcagcgactac

SEQ ID NO: 41576 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcacggagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 41577 - DNA, 355 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccacccttcactcttttggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41578 - DNA, 417 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctgttgccggtgctgtgccaggcccacggcttgaccccggagcaggtggtggccatcgccagccacgatggcggcaagagacctcaagaaagcaatcccacctcactgcttcaaacgctccatcccacgctccttctcctcttcgacatcatcacctcctcctcggctcctccctctaccacctctccacagcctacttcccgctcccttacctcgcctgacccctctactgcgcctgccaaggctgcgtcctaacgggcctctgggtcatagcccacgagtgcggccaccacgccttcagcgactac

SEQ ID NO: 41579 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcacctggcccctctactgggcctgccaaggctgcgtcctaacgggcctctgggtcatcgcccacgaatgcggccaccacgccttcagcgactac

SEQ ID NO: 41580 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgagagacaccacccttcactctcgacctcaagaaagcaatcccacctcactgcttcaaacgctccatccctcgctccttctcctacctactcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41581 - DNA, 350 bp, Artificial
  Mutation in BnaC.FAD2.b introduced by TALE nuclease pair BnFAD2_T03
caggatccatgggagcaggtggaagaatgcaagtctctcctccctccagctcccccgaaaccaaaaccctcaaccgcgtcccctgcgagacaccacccttcactggagacctcaagaaagcaatcccacctcactgcttcaaacgctccatccctcgctccttctcctacctcctcttcgacatcctcgtctcctcctccctctaccacctctccacagcctacttccctctcctccccccccctctccctttcctcgcctggcccctctactgcgcctgccaaggctgcgtcctaacgggcctctgggtcatcgcccacgaatgcggccaccacgccttcagcgactac

SEQ ID NO: 41582 - DNA, 350 bp, Artificial
  Mutation in BnaC.FAD2.b introduced by TALE nuclease pair BnFAD2_T03
caggatccatgggtgcaggtggaagaatgcaagtctctcctccctccaggtcccccgaaaccaacaccatcaaacgcgtaccctgcgagacaccaccattcactctagacctcaagaaagcaatcccacctcactgcttcaaacgctccatcccacgctcctcctcctacctcctcttcgacatcatcgtcgcctcctccctctactacttcgccaccgcctacttccctctcctccccccccctctcccttacctcgcctggcccctctactgggcctgccaaggctgcgtcctaacgggcctctgggtcatcgcccacgagtgcggccaccacgccttcagcgactac

SEQ ID NO: 41583 - DNA, 424 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaccgcgtcccctgcgagacacggtccagcggctgttgccggtgctgtgccaggcccacggcttgacccctcagcaggtggtggccatcgccagcaatggcggcggcaggagacctcaagaaagcaatcccacctcactgcttcaaacgctcaatccctcgctccttctcctacctcctcttcgccatcctcgtctcctcctccccctaccacccctccacagcctacttccctctcctcccccaccctctcccttaccccgcctggcccctctactgggcctgccaaggctgcgtcctaacgggcctctgggtcatcgccgacgaaggcggccaccacgcttcatcgactac

SEQ ID NO: 41584 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctcttcgacatcatcatctcctcctcggctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 41585 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 41586 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccagggctgcgtcctaaccggcgtcggggtcatagcccacgagtgcggccaccacgccttcagcgactac

SEQ ID NO: 41587 - DNA, 304 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactgcttcaaacgctccatccctcgctccttctcctacctcctcttcgacatcctcgtctcctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 41588 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcgagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41589 - DNA, 331 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcctcccctgcgagacaccaccattcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41590 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttagacctcaagaaagcaatcccacctcactgcttcaaacgctcgatccctcgctccttctcctacctcctcttcgacatcctcgtcgcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41591 - DNA, 343 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 41592 - DNA, 354 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggagacctcaagaaagcaatcccacctcactgcttcaaacgctccatccctcgctccttctcctacctcctcttcgacatcctcgtctcctcctccctctaccacccctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41593 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactctgacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41594 - DNA, 324 bp, Artificial
  Mutation in BnaC.FAD2.b introduced by TALE nuclease pair BnFAD2_T03
caggatccatgggtgcaggtggaagaatgcaagtttctcctccctccagctcccccgaaaccaaaaccctcaaacgcgtcccctgcgagacaccacccttcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41595 - DNA, 394 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggctgcggcgagcggtatcagctcactcaaaggcggtaatacggttatccacagaatcagacctcaagaaagcaatcccacctcactgcttcaaacgctccatccctcgctccttctcctacctcctcttcgacatcctcgtctcctcctccctctcccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41596 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccactacgccttcagcgactac

SEQ ID NO: 41597 - DNA, 331 bp, Artificial
  Mutation in BnaC.FAD2.b introduced by TALE nuclease pair BnFAD2_T03
caggatccatgggtgcaggtggaagaatccaagtctctactccctccagctcccccgaaaccaaaaccctcaaacgcgtcccctgcgagacaccaccattcagacctcaagaaagcaatcccacctcactgcttcaaacgctccatcccacgctccttctcctcttcgacaccatcatctcctcctcggctcctccctctaccacctctccacagcctacttccctctcccttacctcgcctagcccctctccggggccggccaaggctgcgtctgaatgcgcctggaggtcatagcccgcgagtgcggccaccgcgccatcagcaactac

SEQ ID NO: 41598 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgcgcctggcccctctactgggcctgccaaggctgcgtcctaacgggcctctgggtcatcgcccacgaatgcggccaccacgccttcagcgactac

SEQ ID NO: 41599 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 41600 - DNA, 418 bp, Artificial
  Mutation in BnaC.FAD2.b introduced by TALE nuclease pair BnFAD2_T03
caggatccatgggtgcaggcggaagaatgcaagtctctcctccctccagctcccccggaaccaacaccctcaaacgcgtcccctgcgagacaccacccttcactctcggcggatttgtcctactcaggagagcgttcaccgacaaacaacagataaaacgaaaggctcagtctttgacctcaagaaagcaatcccacctcactgcttcaaacgctccatccctcgctccttctcctacctcctcttcgacatcctcgtcccctcctccctctaccacccccccacagcctacttccctctcctccccctccccctcccttacctcgcctggcccctctactgggcctgccaaggctgcgtcctaacgggcttctgggtcatagcccacgagtgcgaccacctcgccttgagcgactac

SEQ ID NO: 41601 - DNA, 384 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacggtccagcggctgttgccggtgctgtgccaggcccacggcttgaccccggagcaggtggtggccagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41602 - DNA, 304 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41603 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcttgacctcaagaaagcaatcccacctcactgcttcaaacttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41604 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacagaccccaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41605 - DNA, 311 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctcaccctctctcctacttcgcctggcctctctcctgggcctgccagggctgcgtcctaaccggcgtctgggtcatagcccacgagtgcggccaccacgccttcagcgacta

SEQ ID NO: 41606 - DNA, 344 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgacgggagaactcaagaaagcaatcccacctcactgcttcaaacgctccatccctcgctccttctcctacctcctcttcgacatcctcgtctcctcctccctctaccacctctccacagcctacttccctcttctcccccaccctctcccttacctcgcctggcccctctactgggcctgccaaggctgcgtcctaacgggcctctgggtcatcgcccacgaatgcggccaccacgccttcagcgactac

SEQ ID NO: 41607 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcagggtcatcgcccacgaatgcggccaccacgccttcagcgactac

SEQ ID NO: 41608 - DNA, 342 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccacctcactgcttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41609 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaccgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctccctttcctcgcctggcccctctactgggccggccaaggctgcgtcctaacgggcctcggggtcatctcccgcgaatgcggccaccacgccttcatcgactac

SEQ ID NO: 41610 - DNA, 323 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41611 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 41612 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctgacgggcctctgggtcatagcccacgagtgtggccaccacgccttcagcgactac

SEQ ID NO: 41613 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctccccccccctctcccttccctcgcctggcccctctactgggcctgccaaggctgcgtcctaacgggcctctgggtcatagcccacgagtgcggccaccacgccttcagcgactac

SEQ ID NO: 41614 - DNA, 347 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccatcaaacgcgtcccctgcgagacaccaccattcactctcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtctgaaccggcgtctgggtcatagcccacgagttcggccaccacgccttcagcgactac

SEQ ID NO: 41615 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctccctctaccacctctccacagcctacttccctctcctcccccaccctctcccttaccccgcctggcccctctactgggcctgccaagggtgcgtcctaaccggcgtctgggtcatagcccacgagggcggccaccacgcttcagcgactac

SEQ ID NO: 41616 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctccgccggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41617 - DNA, 394 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttggccaccacctgctccggggtcaagctggaggggtacaccttccaccactcgttgggagacctcaagaaagcaatcccacctcactgcttcaaacgctccatcccacgctccttctcctcttcgacatcatcatctcctcctcggctccgccccctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 41618 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgcctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggccggccaaggctgcgtcctaacggtcctctgggtcatcgcccacgaatgcggccaccacgccttcagcgactac

SEQ ID NO: 41619 - DNA, 335 bp, Artificial
  Mutation in BnaC.FAD2.b introduced by TALE nuclease pair BnFAD2_T03
caggatccatgggtgcaggtggaagaatgcaagtctctcccccctccagctcccccggaaccaacaccctcaaccgcgtcccctgcgagacaccaccattcactcagacctcaagaaagcaatcccacctcactgcttcaaacgctccttcccactccccttctcctcttcgacaccatcatctcctcctcggctcctccctctaccacctctccacagcctacttccctctcccttgcctcccctgacccctctactgggcgtgccaaggctgcgtctgaacgggcctcggggtcatatcccacgagtgcggccaccgcgccatcagcgactac

SEQ ID NO: 41620 - DNA, 343 bp, Artificial
  Mutation in BnaC.FAD2.b introduced by TALE nuclease pair BnFAD2_T03
caggatccatgggtgcaggtggaagaatgcaagtgtctcctccccccaagaagtctgaaaccgacaacatcaagcgcgtaccccgcgagacaccgccctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41621 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagaccccacccttcactcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccagggctgcgtccgaaccggcgtctgggtcatagcccacgagtgcggccaccacgccatcagcgactac

SEQ ID NO: 41622 - DNA, 300 bp, Artificial
  Mutation in BnaC.FAD2.b introduced by TALE nuclease pair BnFAD2_T03
caggatccatgggtgcaggtggaagaatgcaagtctatcctccctcccgctcccccgaaaccaaaaccctcaaacgcgtcccctgcgagacaccacctcaagaaagcaatcccacctcactgcttcaaacgctccatcccacgctccttctcctcttcgacatcatcatctcctcctcggctcctccctcaccctctctcctacttcgcctggcctctctactgggcctgccagggctgcgtcctaaccggcgtctgggtcatagcccacgagtgcggccaccacgccttcagcgactac

SEQ ID NO: 41623 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctccatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41624 - DNA, 317 bp, Artificial
  Mutation in BnaC.FAD2.b introduced by TALE nuclease pair BnFAD2_T03
caggatccatgggtgcaggtggaggaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtccgaacgggcctctgggtcatagcccacgagtgcggccaccacgccttcagcgactac

SEQ ID NO: 41625 - DNA, 348 bp, Artificial
  Mutation in BnaC.FAD2.b introduced by TALE nuclease pair BnFAD2_T03
caggatccatgggtgcaggtggaagaatgcaagtctctcctccatccagctcccccgaaaccaaaaccctcaaacgcgtcccctgcgagacaccacccttaactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccagggctgcgtcctaacgggcctctgggtcatagcccacgagtgcggccaccacgccttcagcgacc

SEQ ID NO: 41626 - DNA, 349 bp, Artificial
  Mutation in BnaC.FAD2.b introduced by TALE nuclease pair BnFAD2_T03
caggatccatggtgcaggtggaagaatgcaagtctctcctccctccagctcccccggaaccaacaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41627 - DNA, 343 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccgagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41628 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 41629 - DNA, 389 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttggcgatggccaccacctgctggggggtcaagccgtgggcctggcacagcaccagaactcaagaaagcaatcccacctcactgcttcaaacgctccatcccacgctccttctcctcttcgacatcatcatctcctcctcggctcctccccctcccacctccccacagcctacttccctctcccttacctcgcctgacccctctactgggcctgccaaggctgcgtcctaacgggcctcggggtcatcgcccacgaatgcggccaccacgccttcagcgactac

SEQ ID NO: 41630 - DNA, 389 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttggcgatggccaccacctgctggggggtcaagccgtgggcctggcacagcaccagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41631 - DNA, 349 bp, Artificial
  Mutation in BnaC.FAD2.b introduced by TALE nuclease pair BnFAD2_T03
caggatccatgggtgcaggtggaagaatgcaagtctctcctctctccagctcccccggaaccaacaccctcaaacgcgtcccctgcgagacaccaccattcactctacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41632 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaccccctcaaccgcgtcccctgcgagacacccccattcactgcgacctccagaaagcaatcccccccccctgcttcatcccctccacccctccccccttctcctccctcctcttcgacttcctcgtctcctcctccccctaccacctctccacagcctacttccctctcccttacctcgcctggcccctctactgggcctgccaaggctgcgtcctaacgggcctctgggtcatcgcccacgagtgcggccaccacgccttcagcgactac

SEQ ID NO: 41633 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtccgaacgggcctctgggtcatagcccacgagtgcggccaccacgccttcagcgactac

SEQ ID NO: 41634 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcaagaaagcaatcccacctcactgcttcaaacgctccatcccccgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41635 - DNA, 325 bp, Artificial
  Mutation in BnaC.FAD2.b introduced by TALE nuclease pair BnFAD2_T03
caggatccatgggtgcaggtcgaagaatgcaagtctctcctccctccagctcccccggaaccaacaccctcaaacgcgtcccctgcgagacaccaccattcactctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaactggcctctgggtcatcgcccacgaatgcggccaccacgccatcagcgactac

SEQ ID NO: 41636 - DNA, 335 bp, Artificial
  Mutation in BnaC.FAD2.b introduced by TALE nuclease pair BnFAD2_T03
caggatccatgggtgcaggtggaagaatgcaagtctctcccccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgtgcctgccaaggctgcgtcctaaccggcctctgggtcatagcccacgagtgctgccaccacgccttcagcgactac

SEQ ID NO: 41637 - DNA, 334 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcggggtcatagcccacgagtgcggccaccacgccttcagcgactac

SEQ ID NO: 41638 - DNA, 290 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41639 - DNA, 278 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactctcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 41640 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttccctcgcctgacccctctacagggcctgccaaggctgcgtcctaacgggcctctgggtcatagcccacgagtgcggccaccacgccttcagcgactac

SEQ ID NO: 41641 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41642 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 41643 - DNA, 422 bp, Artificial
  Mutation in BnaC.FAD2.b introduced by TALE nuclease pair BnFAD2_T03
caggatccatgggtgcaggtgaaagaatgcaagtctctcctccctccagctcccccgaaaccaaaaccctcaaccgcgtcccctgcgagacaccaccattcactctatctccagcggctgttgccaccgccattgctggcgatggccaccacctgctggggggtcaagccgtgggcctggcacaccaccgggagacctcaagaaagcaatcccacctcacggcttcaaacgctccatcccacgctccttctcctctccgacatcatcatcccctcctcggctcctccctctcccacctccccgcagcctacttccctctcccttgcctcgcctggcccctctacggggcctgccaaggctgcgtccgaacgggcctcggggtcatagcccacgtgtgctgcgaccgcgccatgagcgactac

SEQ ID NO: 41644 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41645 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaaccaatcccacctcactgcttcaaacgctccatcccacgctccttctcttcttcgacatcatcatctcctcctcggcgcctccctctaccacctctccacagcctactcccctctcccttacctcgcctgacccctctactgggcctgccaaggctgcgtcctaacgggcgtctgggtcatcgcccacgaatgcggccaccacgccttcagcgactac

SEQ ID NO: 41646 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 41647 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgccagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41648 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcggggtcatcgcccacgaatgcggccaccgcgccttcagcgactac

SEQ ID NO: 41649 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccacccttcactctaccacactgcttcaaacgctccatccctcgctccttctcctacctcctctccgacatcctcgtctcctcctccttctaccacctctccacagcctacttccctctcctcccccaccctctcccttacctcgcctggcccctctactgggcctgccaaggctgcgtccgaacgggcgtctgggtcatagcccacgaatgcggccaccacgccatcagcgactac

SEQ ID NO: 41650 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41651 - DNA, 333 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41652 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41653 - DNA, 358 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtagaactcaagaaagcaatcccaccgcactgtttcaaacgctcgatccctcgctctttctcctacctcatctgggacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41654 - DNA, 265 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41655 - DNA, 334 bp, Artificial
  Mutation in BnaC.FAD2.b introduced by TALE nuclease pair BnFAD2_T03
caggatccatgggtgcaggtggaagaatgcaagtgtctcatccctccaagaagtctgaaaccgacaccatcaagcgcgtaccctgcgagacaccgcccttcactgtaactcaagaaagcaatcccaccgcactgtttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgctgccaccacgccttcagcgactac

SEQ ID NO: 41656 - DNA, 300 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 41657 - DNA, 354 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41658 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccatcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 41659 - DNA, 354 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaccgcgtcccctgcgagacaccacccttcactctcgggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaactggcctctgggtcatagcccacgagtgcggccaccacgccttcagcgactac

SEQ ID NO: 41660 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcgacctcaagaaagcaatcccacctcactgcttcaaacgctccatcccacgctccttctactcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41661 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatccaacctcactgcttcaaacgccccatcccaccctccttctcctcttcgccaccatcacctcctcctcggctcctccctctcccacctctccacagcctacttccctctcccttacctcgcctgtcccctctactgggcctgccaaggctgcgtcctaacgggcctctgggtcatagcccacgagtgcggccaccacgccttcagcgactac

SEQ ID NO: 41662 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagcctacttccctctcctccccccccctctcccttgcctcgcctggcccctctactgggcctgccaaggctgcgtcctaacgggcctcggggtcatcgcccacgaatgcggccaccacgccttcagcgactac

SEQ ID NO: 41663 - DNA, 336 bp, Artificial
  Mutation in BnaC.FAD2.b introduced by TALE nuclease pair BnFAD2_T03
caggatccatgggtgcaggtggaagaatgcaagtctctactccctccagctcccccgaaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41664 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcttcctaacgggcctctgggtcatcgcccacgaatgcggccaccacgccttcagcgactac

SEQ ID NO: 41665 - DNA, 411 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtggcaagcaggcgctggagacggtccagcggctgttgccggtgctgtgccaggcccacggcttgaccccggaagacctcaagaaagcaatcccacctcactgcttcaaccgctccatcccacgctccttctcctcttcgacaccatcacctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 41666 - DNA, 257 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagctactac

SEQ ID NO: 41667 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcttctgggtcatagccctcgagtgcggccaccacgccttcagccactac

SEQ ID NO: 41668 - DNA, 331 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgagtaccctgcgagacaccgcccttcacaactcaagaaagcaatcccaccgcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41669 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcggggtcatagcccacgagtgcggccaccacgccttcagcgactac

SEQ ID NO: 41670 - DNA, 343 bp, Artificial
  Mutation in BnaC.FAD2.b introduced by TALE nuclease pair BnFAD2_T03
caggatccatgggtgcaggtggaagaatgcaagtctctcattcctccagctcccccgaaaacaaaaccctcaaacacgtccccagcgagacaccacccttcactctagaactcaagaaagcaatcccacctcactgcttcaaacgctccatcccaccctccttctcctcttcgacatcatcatctcctcctccctctaccacctctccacagcctacttccctctcctcccccaccctctcccttacctcgccaagcccctctactgggccggccaaggctgcgtccgaacgggcctcggggtcatcgcccgcgaatgcggccaccgcgccatcagcgactac

SEQ ID NO: 41671 - DNA, 331 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttaagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgccttcatcgactac

SEQ ID NO: 41672 - DNA, 351 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactctcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41673 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaacccaaaaccctcaaacgcgtcccctgcgagacaccacccttcacttagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41674 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 41675 - DNA, 335 bp, Artificial
  Mutation in BnaC.FAD2.b introduced by TALE nuclease pair BnFAD2_T03
caggatccatgggtgcaggtggaagaatgcaagtctctcctccctcccgctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41676 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaagcgcgtcccctgcgagacaccaccattcactctagacctcaagaaagcaatcccacctcactgcttcaaacgctccatcccaccctccttctcctcttcgacatcatcatctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 41677 - DNA, 347 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcactcgcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 41678 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41679 - DNA, 410 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcaggggaagccgaagtttccaaaaggtcgttgatcaaagctcgccgcgttgtttcatcggagacctcaagaaagcaatcccacctcactgcttcaaacgctccatccctcgctccttctcctacctcctcttcgacatcctcgtcacctcctccctctaccacctccccacagcctacttccctcccctcccccaccctctcccttacctcgcctggcccctctactgggcctgccaaggctgcgtcctaacgggcctctgggtcatagcccacgagtgcggccaccacgccttcagcgactac

SEQ ID NO: 41680 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctcgcccctctactgggcctgccaaggctgcgtcctaacgggcctctgggtcatagcccacgagtgcggccaccacgccttcagcgactac

SEQ ID NO: 41681 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccgaaaacatcaaacgcgtaccctgcgagacaccacccttcactcagacctcaagaaagcaatcccacctcactccttcaaacgctccatccctcgctccttctcctacctcctcttcgacatcctcgtctcctcctccctctaccacctctccacagcctacttccctctccccccccaccctctcccttacctcgcctggcccctctactgggcctgccaaggctgcgtcctaacgggcctctgggtcatagcccacgaatgcggccaccacgccttcagcgactac

SEQ ID NO: 41682 - DNA, 289 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 41683 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttgacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctcggggtcatagcccacgagtgcggccaccacgccttcagcgactac

SEQ ID NO: 41684 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgattgcggccaccacgccttcagcgactac

SEQ ID NO: 41685 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcggaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 41686 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacaagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 41687 - DNA, 414 bp, Artificial
  Mutation in BnaC.FAD2.b introduced by TALE nuclease pair BnFAD2_T03
caggatccattggtgcaggtggaagaatgcaagtctctcctccctccagctcccccggaaccaacaccatcaaacgcgtcccctgcgagacaccaccattcactctcaggcgctggagacggtccagcggctgttgccggtgctgtgccaggcccacggcttgaccccggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaattcggccaccacgccatcagcgactac

SEQ ID NO: 41688 - DNA, 373 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgcgttatcccctgattctgtggataaccgtattaccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41689 - DNA, 330 bp, Artificial
  Mutation in BnaC.FAD2.b introduced by TALE nuclease pair BnFAD2_T03
caggatccatgggtgcaggtggaagaatgcaagtctctcatccctccagctcccccggaaccaacaccctcaaacgcgtcccctgcgagacaccaccattagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41690 - DNA, 342 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccaaaaccctcaaacgcgtcccctgcgagacaccacccttcactcaagaaagcaatcccacctcactgcttcaaacgctccatccctcgctccttttcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41691 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggcttcgtcctaacgggcctctgggtcatagcccacgagtgcggccaccacgccttcagcgactac

SEQ ID NO: 41692 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcacttagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41693 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggcttcgtcctaacgggcctctgggtcatagcccacgagtgcggccaccacgccttcagcgactac

SEQ ID NO: 41694 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgcaaaggctgcgtccgaacgggcctcggggtcatatcccacgagtgcggccaccgcgccttcagcgactac

SEQ ID NO: 41695 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgccatcctcgtctcctcctccctctaccacctctccacagcctacttccctctcctcccccaccctctcccttacctcgcctggcccctctactgggcctgccaagggtgcgtcctaacgggcctctgggtcatagcccacgagtgcggccaccacgccttcagcgactac

SEQ ID NO: 41696 - DNA, 397 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcaccctgaccctggaggaggtgactgatagtgacctgttcgttgcaacaaattgataagcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacggacctctgggtcatagcccacgagtgcggccaccacgccttcagcgactac

SEQ ID NO: 41697 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaaagacctcaagaaagcaatcccacctcactgcttcaaacgctccatcccacgctccttatcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcgtccaccacgccttcagcgctac

SEQ ID NO: 41698 - DNA, 349 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccgggcccctctactgggcctgccaaggctgcgtcctaacgggcctcggggtcatcgcccacgaatgcggccaccacgccttcagcgactac

SEQ ID NO: 41699 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcggggtcatcgcccacgaatgcggccaccacgccttcagcgactac

SEQ ID NO: 41700 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 41701 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactccagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41702 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccatctcccttacctcgcctgacccctctactgggcctgccaaggctgcgtcctaacgggcctctgggtcatagcccacgagtgcggccaccacgccttcagcgactac

SEQ ID NO: 41703 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccatctcccttacctcgcctgacccctctactgggcctgccaaggctccgtcctaacgggcctctgggtcatagcccacgagttcggccaccacgccttcagcgactac

SEQ ID NO: 41704 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccacaagaaagcaatcccacctcactgcttcaaacgctccatccctcgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 41705 - DNA, 478 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgctgcgcgtaactggcacagcaccggcaacagccgctggaccgtctccagcgcctgcttgccaccgccattgctggcgatggccaccacctgctggggggtcaagccgtgggcctggcacagcaccggcaacagccgctggaccacacctcaagaaagccaccccccccccctgcttccacccccccatcccccgctccttctcctctccgacctccccatctcctcctcggctcctcccccaccctctccccagcctacttccctctcccttccctcccctgacccctctactgggcctgccaaggctgcgtcctaacgggcctctgggtcatagcccacgagtgcggccaccacgccttcagcgactac

SEQ ID NO: 41706 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgaatgcggccaccacgccttcagcgactac

SEQ ID NO: 41707 - DNA, 293 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaagaaagcaatcccacctcactgcttcaaacgctccatcccacgctcctcctcctcttcgacatcatcatctcctcctccctctaccacctctccacagcctacttccctctcctcccctaccctctctcctacttcgcctggcctctctactgggcctgccagggctgcgtcctaaccggcgtctgggtcatagcccacgagtgcggccaccacgccttcagcgactac

SEQ ID NO: 41708 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatagcccacgagtgcggccaccacgccctcagcgactac

SEQ ID NO: 41709 - DNA, 340 bp, Artificial
  Mutation in BnaC.FAD2.b introduced by TALE nuclease pair BnFAD2_T03
caggatccatgggtgcaggtggaagaatgcaagtctctcctccctccagctccccgaaaccaacaccctcaaacgcgtcccctgcgagacaccacccttcactctaccccaagaaagcaatcccacctcactgcttcaaacgctccatccctcgctccttctcctacctcctcttcgacatcatcatctcctcctcggctcctccctccaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41710 - DNA, 349 bp, Artificial
  Mutation in BnaC.FAD2.b introduced by TALE nuclease pair BnFAD2_T03
caggatccatgggtgcaggtggaagaatgcaagtctctcctgcctccagctcccccggaaccaacaccctcaaacgcgtcccctgcgagacaccacccttcacacagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctggcccctctactgggcctgccaaggctgcgtcctaacgggcctcttggtcatcgcccgcgaatgctgccaccacgccatcagcgactac

SEQ ID NO: 41711 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgtgtcatagcccgcgagtgcggccaccacgccttcatcgactac

SEQ ID NO: 41712 - DNA, 349 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttctgcgactac

SEQ ID NO: 41713 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41714 - DNA, 354 bp, Artificial
  Mutation in BnaC.FAD2.b introduced by TALE nuclease pair BnFAD2_T03
caggatccatgggtgcaggtggaagaatgcaagtctctactcgctccagctcccccgaaaccaaaaccctcaaacgcgtcccctgcgagacaccacccttcactctcgggagacctcaagaaagcaatcccacctcactgcttcaaacgctccatccctcgctccttctcctacctcctcttcgacatcctcgtctcctcctccctctaccacccctccacagcctacttccctctcctccaccaccctctcccttacctcgcctggcccctctactgggcctgccaaggctgcgtcctaacgggcctctgggtcatcgcccacgaatgcggccaccacgccttcagcgactac

SEQ ID NO: 41715 - DNA, 414 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcgctggagacggtccagcggctgttgcctgtgctgtgccaggcccacggcttgaccccccagcaggtggtggccatagacctcaagaaagcaatcccacctcactgcttcaaacgctccatccctcgctccttctcctacctcctcttcgacatcctcgtctcctcctccctctcccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 41716 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctacgagaccccaacaaagcaatccgacctcactgctacaaacgctccatcccaccctccttcccctcctcgccatcatcctctccccctcggctcctcccactaccacctctccacatcctccttccctctcccttacctcgcctgccccctctactgggcctgccaaggctgcgtcctaacgggcctctgggtcatagcccacgagtgcggccaccacgccttcagcgactac

SEQ ID NO: 41717 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcgagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41718 - DNA, 328 bp, Artificial
  Mutation in BnaC.FAD2.b introduced by TALE nuclease pair BnFAD2_T03
caggatccatgggtgcaggtggaagaatgcaagtgtctcctccctccaaaagtctgaaaccgacaacatcaagcgcgtaccctgcgagacaccgcccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41719 - DNA, 315 bp, Artificial
  Mutation in BnaC.FAD2.b introduced by TALE nuclease pair BnFAD2_T03
caggatccatgggtgcaggtggaagaatgcaagtctctcctccctccagctccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccgtcacgactac

SEQ ID NO: 41720 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctccccctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41721 - DNA, 331 bp, Artificial
  Mutation in BnaC.FAD2.b introduced by TALE nuclease pair BnFAD2_T03
caggatccatgggtgcaggtggaagaatgcaagtatatcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41722 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccctcaagaaagcaatcccacctcactgcttcaaacgctccatccctcgctccttctcctacctcctcttcgacatcctcgtctcctcctccctccaccacctctccacagcctacttccctctcctcccccgccctctcccttacctcgcctggcccctctactgggcctgccaaggctgcgtcctaacgggcctcggggtcatcgcccacgaatgcggccaccacgccttcagcgactac

SEQ ID NO: 41723 - DNA, 338 bp, Artificial
  Mutation in BnaC.FAD2.b introduced by TALE nuclease pair BnFAD2_T03
caggatccatgggtgcaggtggaagaatgcaagtttctcctccctcccgctcccccggaaccaacaccctcaaacgcgtcccctgcgagacaccaccattcaagaaagcaatcccacctcactgcttcaaacgctccatcccacgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagggcggccaccacgccttcatcgactac

SEQ ID NO: 41724 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgtgcctctgggtcatcgcccacgtatgcggccaccgcgccttcaacgactac

SEQ ID NO: 41725 - DNA, 336 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41726 - DNA, 346 bp, Artificial
  Mutation in BnaC.FAD2.b introduced by TALE nuclease pair BnFAD2_T03
caggatccatgggtgcaggtggcagaatgcaagtctttcctccctccagctcccccggaaccaaaaccctcaaacgcgtcccctgcgagacaccacccttcacgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41727 - DNA, 347 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcacagacctcaagaaagcaatcccacctcactgcttcaaacgctccatccctcgctccttctcttacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41728 - DNA, 332 bp, Artificial
  Mutation in BnaC.FAD2.b introduced by TALE nuclease pair BnFAD2_T03
caggatccatgggtgcaggtggcagaatgcaagtctctactccctccagctcccccggaaccaacaccctcaaacgcgtcccctgcgagacaccaccattcacttcctcaagaaagcaatcccaccgcactgtttcaaacgctccatcccacgctccttctcctcttcgacatcatcatctcctcctcggctcctccctctacaacctctccacagcctacttccctctcccttacctcgcctgacccctctactgggcctgccaaggctgcgtcctaacgggcctcggggtcatagcccacgagtgcggccaccacgccttcagcgactac

SEQ ID NO: 41729 - DNA, 334 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 41730 - DNA, 402 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactctcggctgttgccggtgctgtgccaggcccacggcttgaccccccagcaggtggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41731 - DNA, 335 bp, Artificial
  Mutation in BnaC.FAD2.b introduced by TALE nuclease pair BnFAD2_T03
caggatccatgggtgcaggtggcagaatgcaagtctctactcccccccgctcccccggaaccaacaccctacaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41732 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaaccccacctcactgcttcaaacgctccatccctcactccttctcctacctcctcttcgacatcctcgtctcctcctccctctaccacccctccacagcctacttccctctccccccccaccctctcccttacctcgcctggcccctctactgggcctgccaaggctgcgtcctaacgggcctctgggtcatcgcccacgaatgcggccaccacgccttcagcgactac

SEQ ID NO: 41733 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccatgacagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgaccac

SEQ ID NO: 41734 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggggtctgggtcatagcccacgagtgcggccaccacgccttcagcgactac

SEQ ID NO: 41735 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaccgcgtcccctgcgagacaccatcggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccgcgagtgcggccaccacgccatcagcgactac

SEQ ID NO: 41736 - DNA, 410 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccatcaaacgcgtcccctgcgagacaccacccttcactctaaaaggtagtctctcagacctatgattttgataaattcactattgactcttctcagcgtcagacctcaagaaagcaatcccacctcactgcttcaaacgctccatccctcgctccttctcctacctcctcttcgacatcctcgtctcctcccccctctaccgcctctccacagcctacttccctcgcctccccccccctctcccttacctcgcctggcccctctactgggcctgccaaggctgcttccgaacgggcctctgggtcatcgcccacgaatgcggccaccacgccttcagcgactac

SEQ ID NO: 41737 - DNA, 410 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctaaaaggtagtcactcagacctctgactttgctaaattcactattgactcttctccgcatcagacctcaagaaagcaatcccacctcactgcttcaaacgctccatcccgcgctccttctcctacctcctctgcgacatcctcatctcctcctgcctctaccacctcgccccagcctacttccctctcctcccccaccctctccctttcctcgcctggcccctctactgggcctgccaaggctgcgtcctaacgggcctctgggtcatcgcccacgaatgcggccaccacgccttcagcgactac

SEQ ID NO: 41738 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccatcggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcttcctaacgggcctcggggtcatagcccacgagtgcggccaccacgccttcagcgactac

SEQ ID NO: 41739 - DNA, 335 bp, Artificial
  Mutation in BnaC.FAD2.b introduced by TALE nuclease pair BnFAD2_T03
caggatccatgggtgcaggtggaagaatgcaagtatctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41740 - DNA, 384 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttccccggagcaggtggtggccatcgccagcaatattggtggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41741 - DNA, 466 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggttctgagggtggcggctctgagggtggcggcactaatcctcctgagtacggtgataccccttgatcatgagcggagaattaagggaatacgtctccagcgcctgcttgccaccgccattgctggcgaagacctcaagaaagcaagcccacctcacggctccaatcgctccatccctcgctccttctcctcttcgacatcatcacctcctcctcggctcctccctctaccccctctccacagcctacttccctctccctgacctcgcctgacccctctactgggcctgccaaggctgcgtcctaacgggcctctgggtcagagcccacgagtgcggccaccacgccttcagcgactac

SEQ ID NO: 41742 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctcgatccctcgctctttctcctacctcatctgggacatcatcatagcctcctgcttctaccacctctccacagcctacttccctctcctcccccaccctctctcctacttcgcctggcctctctactgggcctgccagggctgcgtcctaaccggcgtctgggtcatagcccacgagtgcggccaccacgccatcagcgactac

SEQ ID NO: 41743 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 41744 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgctgcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctcttggtcatcgcccacgagtgcggccaccacgccttcagcgactac

SEQ ID NO: 41745 - DNA, 349 bp, Artificial
  Mutation in BnaC.FAD2.b introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctcgcccctctactgggcctgccaagtctgcgtcctaacgggcctctgggtcatcgcccacgaatgcggccaccacgccttgagcgactac

SEQ ID NO: 41746 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 41747 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccagacctcaagaaagcaatcccacctcactgcttcaaactctccatcccaccctccttctcctcttcgccatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41748 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttaagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 41749 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctcctgcgcctgccaaggctgcgtcctaacgggcctctgggtcatagcccacgagtgcggccaccacgccttcagcgactac

SEQ ID NO: 41750 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctccgagacaccacccttcactcctcaagaaagcaatcccacctcactgcttcaaacgctccatcccacgctccttctcctcttcgacatcatcatctcctcctcggctcctccctctaccacctctccacagcctacttccctctcccttacctcgcctgccccctctactgggccggccaaggctgcgtcctaacgggcctctgggtcatagcccacgagtgcggccaccacgccttcagcgactac

SEQ ID NO: 41751 - DNA, 397 bp, Artificial
  Mutation in BnaC.FAD2.b introduced by TALE nuclease pair BnFAD2_T03
caggatccatgggtgcaggtggaagaatgcaagtctctcctccctccagctcccccgtaaccaacaccatcaaacgcgtcccctgcgagacaccaccattcactcagccgaacgaccgagcgcagcgagtcagtgagcgaggaagcggaagagcgcccaatacgcggagacctcaagaaagcaatcccacctcactgcttcaaacgctccatcccacgctccttctcctcttcgacatcatcatctcctcctcggctcctccctctaccgcctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41752 - DNA, 278 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctcgacatcctcgtctcctcctccctctaccacctctccacagcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 41753 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaacacaagaaagcagtcccccctcactgcttcaaacgctccatccctcgctccttctcctacctcctcttcgacatcctcgtctcctcctccctctaccacctctccaccgcctacttccctctcctcccccaccctctcccttacctcgcctggcccctctactgggcctgccaaggctgcgtcctaacgggcgtctgggtcatcgcccacgaatgcggccaccacgccttcagcgactac

SEQ ID NO: 41754 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaccaccttcaaccgcgtcccctgcgagccacaaccattcactcgagacctcaagaaagcaatcccacttcactgcttcaaaccctccatcccccgccccttctcctcttcgacatcatcatctcctcctcgcctcctccctctaccacctctccacagcctacttccctctcctcccccaccctctcccttacctcgcctggcccctctactgggcctgccaaggctgcgtcctaacgggcctctgggtcatcgcccgcgaatgcggccaccacgccttcagcaactac

SEQ ID NO: 41755 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcttcctaaccggcgtctgggtcatagcccacgagtgcggccaccacgccttcagcgactac

SEQ ID NO: 41756 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaccgcgtcccctgcgagacaccacccttcacagacctcaagaaagcaatcccacctcactgcttcaaacgctccatccctcgctccttctcctacctcctcttcgacatcctcgtctcctcctccctctaccacctctccacagcctacttccctctcctcccccaccctcgcccttgcctcgcctggcccctctactgggcctgccaaggctgcgtcctaacgggcctctgggtcatagcccacgagtgctgccaccacgccatcagcaactac

SEQ ID NO: 41757 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41758 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41759 - DNA, 336 bp, Artificial
  Mutation in BnaC.FAD2.b introduced by TALE nuclease pair BnFAD2_T03
caggatccatgggtgcaggtggaagaatgcaagtctctcctccctcccgctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41760 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcatcctaacgggcctctgggtcatagcccacgagtgcggccaccacgccttcagcgactac

SEQ ID NO: 41761 - DNA, 336 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcggggtcatagcccacgagtgcggccaccacgccttcagcgactac

SEQ ID NO: 41762 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctgacccctctactgggcctgccaagggtgcgtcctaaccggcgtctgggtcatagcccacgagtgcggccaccacgccttcagcgactac

SEQ ID NO: 41763 - DNA, 336 bp, Artificial
  Mutation in BnaC.FAD2.b introduced by TALE nuclease pair BnFAD2_T03
caggatccatgggtgcaggtggaagaatgcaagtatctcctcactccagctcccccggacccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccatcacgcctgcagtgactac

SEQ ID NO: 41764 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41765 - DNA, 335 bp, Artificial
  Mutation in BnaC.FAD2.b introduced by TALE nuclease pair BnFAD2_T03
caggatccatgggtgcaggtggcagaatgcaagtctctcctccctcaagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41766 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccccgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41767 - DNA, 348 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcacttaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41768 - DNA, 346 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtacccggcagacaccgcccttcactgtactcaagaaagcaatcccaccgcactgttccaaacgctccaacccccgctccttcccccacctccttttcgacatcctcgtctccccctcccgctaccacccctccccagcctacttccctcttctcccccaccctctcccttacctcgcctgacccctctactgggcctgccaaggctgcgtcctaacgggcctctgggtcatagcccacgattgcggccaccacgccttcagcgactac

SEQ ID NO: 41769 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41770 - DNA, 421 bp, Artificial
  Mutation in BnaC.FAD2.b introduced by TALE nuclease pair BnFAD2_T03
caggaatccatgggtgcaggtggaagaatgcaagtgtctcctccctccagctcccccggaaccaacaccctcaaacgcgtcccctgcgagacaccaccattcactctcggtgttgtgccaggcccacggcttgaccccggagcaggtggtggccatcgccagccacgatggcggcaacagccgctggacccagacctcaagaaagcaatcccacctcactgcttcaaacgctccatcccacgctccttctcctcttcgacatcatcacctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41771 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41772 - DNA, 338 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgcgcctgccaaggctgcgtcctaacgggcctctgggtcatcgcccacgaatgcggccaccacgccttcagcgactac

SEQ ID NO: 41773 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 41774 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaagcgcgtaccctgcgagacaccgcccttcactgtcctcaagaaagcaatcccacctcactgcttcaaacgctccatcccacgctccttctcctcttcgacatcatcatctcctcctccctctaccacctctccacagcctacttccctctcctcccccaccctctcccttacctcgcctagcccctctactgggcctgccaaggctgcgtcctaacgggcctcggggtcatcgcccacgaatgcggccaccgcgccatcagcgactac

SEQ ID NO: 41775 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacggtcctctgggtcatatcccacgtgtgcggccaccacgccatcagcgactac

SEQ ID NO: 41776 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctccctgcttcaaacgctccatccctcgccccttctcctccctcctcttcgacatcctcgtctcctcctccctctcccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41777 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctcggcttcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41778 - DNA, 336 bp, Artificial
  Mutation in BnaC.FAD2.b introduced by TALE nuclease pair BnFAD2_T03
caggatccatgggtgcaggtggaagaatgcaagtctatcctccctcccgctcccccgaaaccaaaaccctcaaacgcgtcccctgcgagaccccacccttcactctcgacctcaagaaagcaatcccacctcactgcttcaaacgctccatcccaccctccttctcctcttcgacatcatcatctcctcctcggctcctccccctaccacctctcctcagcctactaccctctcccttacctcgccgggcccctctactgggctggtcggggctgcgtgctaacaggcctctgggtcatagcccacgagttcggctaccacgcctttagcaactac

SEQ ID NO: 41779 - DNA, 278 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaccgcgtcccctgcgagacaccacccttcactctcgacatcctcgtctcctcctccctctaccacctctccacagcctacttccctctcctcccccaccctctcccttacctcgcctggcccctctactgggcctgccaaggctgcgtcctaacgggcctcggggtcatcgcccacgaatgcggccaccacgccttcaactactac

SEQ ID NO: 41780 - DNA, 333 bp, Artificial
  Mutation in BnaC.FAD2.b introduced by TALE nuclease pair BnFAD2_T03
catgatccatgggtgcaggtggaagaatgcaagtgtctcctccctccaaaaagtctgaaaccgacaacatcaagcgcgtaccctgcgagacaccgcccttcactgtcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41781 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctcgcccttacctcgcctggcccctctactgggcctgccaaggctgcgtcctaacgggcctctgggtcatcgcccacgaatgcggccaccacgccatcagcgactac

SEQ ID NO: 41782 - DNA, 460 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctctccagcgcctgcttgccgccatcgtggctggcgatggccaccacctgctccggggtcaagccgtgggcctggcacagcaccggcaacagccgctggaccgtctccagcgcctgttgccgccagagacctcaagaaagcaatcccacctcactgctccaaacgctccaccccaccctcctcctcctcgccgacatcatcaactcctcctcggctcctccccctcccacctccccccagcctacttccctctcccttacctcgcctgacccctctactgggcctgccaaggctgcgtcctaacgggcctctgggtcatagcccacgagtgcggccaccacgccttcagcgactac

SEQ ID NO: 41783 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacctcaagcgcgtaccctgcgagacaccgcccttcactgtagacctcaagaaagcaatcccacctcactgcttcaaacgctccatccctcgctccttctcctccctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41784 - DNA, 385 bp, Artificial
  Mutation in BnaC.FAD2.b introduced by TALE nuclease pair BnFAD2_T03
caggacccatgggtgcaggtggaagaatgcaagtgtctcctccctccaaaaagtctgaaaccgacaacatcaaacgcgtcccctgcgagacaccaccattcactctcgcctgcttgccaccgccattgctggcgatggccaccacctttgacctcaagaaagcaatcccacctcactgcttcaaacgctccatcccacgctccttctcctcttcgacatcatcatctcctcctccctctaccacctctccacagcctacttcccgcgcctcccccaccctctccgttacctcgcctggcccctctactgggcctgccaaggctgcgtcctaacgggcctctgggtcatagcccacgagtgcggccaccacgccatcagcgactac

SEQ ID NO: 41785 - DNA, 385 bp, Artificial
  Mutation in BnaC.FAD2.b introduced by TALE nuclease pair BnFAD2_T03
caggatccatgggtgcaggtggaagaatgcaagtgtctcctccctcccaaaagtctgaaaccgacaacatcaaacgcgtcccctgcgagacaccaccattcactctcgcctgcttgccaccgccattgctggcgatggccaccacctttgacctcaagaaagcaatcccacctcactgcttcaaacgctccatccaccgctccttctcctcttcgacatcctcatctcctcctccctctaccacctctccacagcctgctgccctcgcctcccccaccctctccgttacctcgcctggcccctctactgggcctgccaaggctgcgtccgaacgggcctctgggtcatagcccacgagtgcggccaccacgccctcagcgactac

SEQ ID NO: 41786 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccccctactgggcctgccaaggctgcgtcctaaccggcctctgggtcatcgcccacgaatgcggccaccacgccttcagcgactac

SEQ ID NO: 41787 - DNA, 317 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccactagtgcggccaccacgccttcagcgactac

SEQ ID NO: 41788 - DNA, 348 bp, Artificial
  Mutation in BnaC.FAD2.b introduced by TALE nuclease pair BnFAD2_T03
caggatccatgggtgcaggtagcagaatgcaagtctctcctccctccagctcccccgaaaccaaaaccctccaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgctcacgaatgcggccaccacgccttcaacgactac

SEQ ID NO: 41789 - DNA, 334 bp, Artificial
  Mutation in BnaC.FAD2.b introduced by TALE nuclease pair BnFAD2_T03
caggatcatgggtgcaggtggaagaatgcaagtctctcctccctccagctcccccggaaccaacaccctcaaacgcgtcccctgcgagacaccaccattcactcggacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41790 - DNA, 336 bp, Artificial
  Mutation in BnaC.FAD2.b introduced by TALE nuclease pair BnFAD2_T03
caggatccatgggtgcaggtggaagaatgcaagtctctcctcactcccgctcccccgaaaccaaaaccctcaaacgcgtcccctgcgagacaccaccattcactcatgacctcaagaaagcaatcccacctcactgcttcaaacgctccatcccacgctccttctcctcttcgacatcatcatctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 41791 - DNA, 336 bp, Artificial
  Mutation in BnaC.FAD2.b introduced by TALE nuclease pair BnFAD2_T03
caggatccatgggtgcaggtagaagaatgcaagtctctcctccctccagctcccccggaaccaacaccctcaaacgcgtcccctgcgagacaccaccattcactctagacctcaagaaagcaatcccacctcactgcttcaaacgctccatcccacgccccttctcctcttcgccatcatcatctcctcctcggctcctccctctaccacctctccacagcctccttccctctcccttacctcgcctgacccctctactgggcctgtcaaggctgcgtcctaacgggcctctgggtcatagcccacgagtgcggccaccacgccttcagcgactac

SEQ ID NO: 41792 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatccccgtctcctcctccctctaccacctcgccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41793 - DNA, 436 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgttgagcgatcgttggcgtcggcaaacagtggtccggcgcacgcgctctggaggccttgctcacggtggcgggagagttgagaggtccaccgttacagttggagaactcaagaaagcaatcccaccgcactgcttcaaacgctccatcccactctccttctcctcttcgacaccatcacctcctcctcggctcctccctctcccacctctccacagcctacttccctctcccttccctcgcctcacccctctactgggcctgccaaggctgcgtcctaacgggcctctgggtcatagcccacgagtgcggccaccacgccttcagcgactac

SEQ ID NO: 41794 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgctagacaccaccattcatgaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41795 - DNA, 295 bp, Artificial
  Mutation in BnaC.FAD2.b introduced by TALE nuclease pair BnFAD2_T03
caggatccatgggtgcaggtggaagaatgcaagtctctcatccccccaggtagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 41796 - DNA, 279 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 41797 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctaacccctctactgggcctgccaaggctgcgtcctaacgggcctctgggtcatagcccacgagtgcggccaccacgccttcagcgactac

SEQ ID NO: 41798 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaacgctccatccctcgctccttctcctacctcctcttcgacatcctcgtctcctcctcccactaccacctctccacagcctacttccctctcctcccccaccctctcccttacctcgcctggcccctctactgggcctgccaaggctgcgtcctaacgggcctctgggtcattgcccacgaatgcggccaccacgccttcagcgactac

SEQ ID NO: 41799 - DNA, 329 bp, Artificial
  Mutation in BnaC.FAD2.b introduced by TALE nuclease pair BnFAD2_T03
caggatccatgggtgcaggtggcagaatgcaagtatctcctccctccagctcccccggaaccaacaccctcaaacgcgtcccctgcgagacaccaccattcactctcggaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggccgctgggtcatagcccacgagtgcggccaccacgccttcagcgactac

SEQ ID NO: 41800 - DNA, 343 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccaccattcactctcggtcggagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 41801 - DNA, 348 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcggggtcatagcccacgagtgcggcctccacgccttcagcgactac

SEQ ID NO: 41802 - DNA, 337 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccacccttaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41803 - DNA, 335 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctggggcatagcccacgagtgcggccaccacgccttcagggactac

SEQ ID NO: 41804 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcctcccccaccctctcccttccctcgcctggcccctctcctgggcctgccaaggctgcttcctaacgggcctctgggtcatcgcccacgagtgcggccaccacgccttcagcgactac

SEQ ID NO: 41805 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaagacctcaagaaagcaatcccacctcactgcttcaaacgctccatcccacgctccttctcctcttcgacatcctcgtctcctcctccctctaccacctctccacaacctacttccctctcctcccccaccctctcccttacctcgcctgacccctctactgggcctgccaaggctgcgtcctaacgggcctctgggtcatagcccacgagtgcggccaccacgccatcagcgactac

SEQ ID NO: 41806 - DNA, 405 bp, Artificial
  Mutation in BnaC.FAD2.b introduced by TALE nuclease pair BnFAD2_T03
caggatccatgggtgcaggtggcagaatgcaagtgtctcctccctcaaaaaagtctgaaaccgacaacatcaagcgcgtaccctgcgagacaccgcccttcactgtccgactgagcctttcgttttatctgttgtttgtcggtgaacgctctcctgagtaggacaaatccgccggagaactcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41807 - DNA, 332 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactcacctcaagaaagcaatcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaaccggcgtctgggtcatagcccacgagtgcggccaccacgccttcagcgactac

SEQ ID NO: 41808 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtccggccaccacgccttcagcgactac

SEQ ID NO: 41809 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactcttagacctcaagaaagcaatcccacctcactgcttcaaacgctccatccctcgctccttctcctacctcctcttcgacatcctcgtctcctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 41810 - DNA, 347 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41811 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41812 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaacccctcaaacgcgtcccctgcgcgaaaccacccttcactcaacctcaagaaagcaatcccacctcactgcttcaaacgctccatccctcgctccttctcctacctcctcttcgacatcctcgtctcctcctccctctaccacctctccacagcctccttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41813 - DNA, 415 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgccagccacgatggcggcaagcaggcgctggagacggtccagcggctgttgccggtgctgtgccagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatagcccacgagtgcggccaccacgccttcagcgactac

SEQ ID NO: 41814 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaacccaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41815 - DNA, 395 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccatcaaacgcgtcccctggcgatggccaccaccattcactcggggggtcaagccgtgggcctggcacagcaccggcaacagccgcagacctcaagaaagcaatcccacctcactgcttcaaacgctccatcccacgctccttctcctacctcctcttcgacatcctcgtctcctcctccctctcccccctccccacagcctacttccctctcctcccccaccctcccccttcccccgcctggcccctctactgggcctgccaaggctgcgtcctaacgggcctctgggtcatcgcccacgaatgcggccaccacgccttcagcgacta

SEQ ID NO: 41816 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtcctaaccggcgtctgggtcatagccctcgagtgcggccaccacgccttcatcgactac

SEQ ID NO: 41817 - DNA, 327 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacatcaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgtgcctgccaaggctgcgtcctaaccggcgtctgtggcatagcccacgagtgcggccaccacgccttcagcgactac

SEQ ID NO: 41818 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 41819 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacaagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 41820 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctaccgggcctgccaaggctgcgtcctaacgggcctctgggtcatagcccacgagtgcggccaccacgccttcagcgactac

SEQ ID NO: 41821 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcacttagacctcaagaaagcaatcccacctcactgcttcaaacgctccatcccaccctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41822 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcataacgggcctctgggtcatcgcccacgaatgcggccaccacgccttcagcgactac

SEQ ID NO: 41823 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41824 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41825 - DNA, 349 bp, Artificial
  Mutation in BnaC.FAD2.b introduced by TALE nuclease pair BnFAD2_T03
caggatccatgggtgcaggtggaagaatgcaagtgtatactccctccaaaaggtctgaaaccgacaacatcaaacgcgtcccctgcgagacaccaccattcacccagacctcaagaaagcaatcccacctcactgcttcaaacgctccatccctcgctccttctcctacctcctcttcgacatcctcgtctcctactccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41826 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctccctccttctcctacctcctcttcgacatcctcgtctcctcctccctctaccccccctccccagcctactcccctcccctcccccaccctctcccttccctcgcctggcccctctactgggcctgccaaggctgcgtcctaacgggcctctgggtcatcgcccacgaatgcggccaccacgccttcagcgactac

SEQ ID NO: 41827 - DNA, 296 bp, Artificial
  Mutation in BnaC.FAD2.b introduced by TALE nuclease pair BnFAD2_T03
caggatccatgggagcaggtggtggccatcgccagccacgatggcggcaagagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41828 - DNA, 347 bp, Artificial
  Mutation in BnaC.FAD2.b introduced by TALE nuclease pair BnFAD2_T03
caggatccatgggtgcaggtggaagaatgcaagtatctcctccctccagctcccccgaaaccaaaaccctcaaacgcgtcccctgcgagacaccacccttcacagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41829 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41830 - DNA, 348 bp, Artificial
  Mutation in BnaC.FAD2.b introduced by TALE nuclease pair BnFAD2_T03
caggatccatgggtgcaggtggaagaatgcaagtatctcctccctccagctcccccgaaaccaaaaccctcaaacgcgtcccctgcgagacaccacccttcactcgacctcaagaaagcaatcccacctcactgcttcaaacgctccatacctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41831 - DNA, 336 bp, Artificial
  Mutation in BnaC.FAD2.b introduced by TALE nuclease pair BnFAD2_T03
caggatccatgggtgcaggtggaagaatgcaagtctctcctccctccagatcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41832 - DNA, 349 bp, Artificial
  Mutation in BnaC.FAD2.b introduced by TALE nuclease pair BnFAD2_T03
caggatccatgggtgcaggtggcagaatgcaagtctatactccctcccgctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgcctgcatcgactac

SEQ ID NO: 41833 - DNA, 348 bp, Artificial
  Mutation in BnaC.FAD2.b introduced by TALE nuclease pair BnFAD2_T03
caggatccatgggtgcaggtggcagaatgcaagtctatactccctccagctcccccggaaccaacaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttgcctcgcctggcccctctactgggcctgccaaggctgcgtcctaacgggcctctgggtcatcgcccgcgaatgcggccaccacgccttcagcgactac

SEQ ID NO: 41834 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgtcgagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41835 - DNA, 342 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactcaggaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggtctctgggtcatcgcccacgagtgcggccaccacgccttcagcgactac

SEQ ID NO: 41836 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccccctcactgcttcaaacgctccatccctcactccttctcctccctcctcttcgacaccatcatctcctcctcgtctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41837 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41838 - DNA, 382 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaacaccatcaacatcgtggctggcgatggccaccacctgtgccaggcccacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41839 - DNA, 331 bp, Artificial
  Mutation in BnaC.FAD2.b introduced by TALE nuclease pair BnFAD2_T03
caggatccatgggtgcaggtggcagaatgcaagtctatcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41840 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 41841 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41842 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgcctcaagaaagcaatcccacctcactgcttcaaacgctccatccctcgctccttctcctcttcgacatcatcatctcctcctcggctcctccctctgccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41843 - DNA, 342 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 41844 - DNA, 308 bp, Artificial
  Mutation in BnaC.FAD2.b introduced by TALE nuclease pair BnFAD2_T03
caggatccatgggtgcaggtggcagaatgcaagtgtctcctccctccaagaagtctgaaaccgacaccatcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41845 - DNA, 331 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaactcaagaaagcaatcccaccgcactgtttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 41846 - DNA, 342 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 41847 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatccctcgctccttctcctacctcctcttcgacatcctcgtctcctcctccctctaccacgtctccacagcctacttccctctcctccctcaccctctctcctacgacgcctggcctctctactgggccggccagggctgcgtcctaaccggcgtctgggtcatagcccacgagggcggccaccacgccttcagcgactac

SEQ ID NO: 41848 - DNA, 335 bp, Artificial
  Mutation in BnaC.FAD2.b introduced by TALE nuclease pair BnFAD2_T03
caggatccatgggtgcaggtggaagaatgtaagtctctcctccctccagctcccccggaaccaacaccctcaaacgcgtcccctgcgagacaccaccattcacttagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41849 - DNA, 350 bp, Artificial
  Mutation in BnaC.FAD2.b introduced by TALE nuclease pair BnFAD2_T03
caggatccatgggtgcaggtggaagaatgcaagtctctcctccctcccgctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaaggcggccgccacgccttcagcgactac

SEQ ID NO: 41850 - DNA, 330 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41851 - DNA, 350 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcacatgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41852 - DNA, 317 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacacctctactgggcctgccaaggctgcgtcctaacgggcctctgggtcatagcccacgagtgcggccaccacgccttcagcgactac

SEQ ID NO: 41853 - DNA, 330 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41854 - DNA, 361 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgctgcgtaacatcgttgctgctccagagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41855 - DNA, 327 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggccagccaaggctgcgtcctaacgggcctctgggtcatagcccacgagtgcggcctccacgcctgcagcgactac

SEQ ID NO: 41856 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggccatcgtccacgaatgcggccaccacgccttcagcgactac

SEQ ID NO: 41857 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 41858 - DNA, 397 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtcccctgcgagacaccacccttcactctcgcaattaatacgcgtaccgctagccaggaagagtttgtagaaacgcaaaacggagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 41859 - DNA, 400 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctggcaacgctgcgatcatgtcctgatacttgacagcgacggtccctatcgcagacctcaagaaagcaatcccacctcactgcttcaaacgctccatccctcgctccttctcctacctcctcttcgacatcctcgtctcctcctccctctaccacccctccccagcctccttccctctcctcccccaccctctcccttacctcgcctggcccctctacggggcctgccaaggctgtgtcctaacgggcctctgggtcatagcccacgagtgcggccaccacgccttcagcgactac

SEQ ID NO: 41860 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgatacaccaccgacctcaagaaagcaatcccacctcactgcttcaaccgccccatcccaccctccttctcctctccgacatcctcatctcctcctcggctcctccctctcccacctctccacagcctactcccctctcccttccctcgcctgacccctctactgggcctgccaaggctgcgtcctaacgggcctctgggtcatcgcccacgaatgcggccaccacgccttcagcgactac

SEQ ID NO: 41861 - DNA, 335 bp, Artificial
  Mutation in BnaC.FAD2.b introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtgaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41862 - DNA, 281 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41863 - DNA, 363 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgcgatggcggcaagcaggcgctggagaagacctcaagaaagcaatcccacctcactgcttcaaacgctccatcccacgctccttctcctcttcgacatcatcatctcctcctcggctcctccctctaccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 41864 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41865 - DNA, 317 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41866 - DNA, 342 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgtgtcatcgcccacgaatgcggccaccacgccttcagcgactac

SEQ ID NO: 41867 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctccctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41868 - DNA, 332 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcacttcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41869 - DNA, 335 bp, Artificial
  Mutation in BnaC.FAD2.b introduced by TALE nuclease pair BnFAD2_T03
caggatccatgggtgcaggtggaagaatgcaagtctctactcccacaagctcccccggaaacaacaccctcaaacgcgtcccctgcgagacaccaccattcactctgacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctacggggcctgccaaggctgcgtcctaacgggcctctggggcatagcccacgagtgcggcctccacgccttcagcgactac

SEQ ID NO: 41870 - DNA, 418 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcggatttgtcctactcaggagagcgttcaccgacaaacaacagataaaacgaaaggctcagtctttgacctcaagaaagcaatcccacctcactgcttcaaacgctccatccctcgctccttctcctacctcctcttcgacatccccgtctcctcctccctctaccacctctccacagcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 41871 - DNA, 349 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41872 - DNA, 310 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41873 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 41874 - DNA, 349 bp, Artificial
  Mutation in BnaC.FAD2.b introduced by TALE nuclease pair BnFAD2_T03
caggatccatgggtgcaggtagaagaatgcaagtctctcctcactccagctcccccgaaaccaaaaccatccaacgcgtcccctgcgagacaccacccttcactctgacctcaagaaagcaatcccacctcactgcttcaaacgctacatccctcgctccttctcctacctcctcttcgacatcctcgtctcctcctccctctaccacctctccacagcctactaccctctcctcccccaccctctcccttacctcgcctggcccctctactgggcctgccaaggctgcgtcctaacgggcctctgggtcatcgcccacgaaggcgtcctccacgcctgcagcgactac

SEQ ID NO: 41875 - DNA, 340 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtacggctgcggcgagcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttcccgcgcctggcccctctactgggcctgccaaggctgcgtcctaacgggcctctgggtcatagcccacgagtgcggccaccacgccttcagcgactac

SEQ ID NO: 41876 - DNA, 337 bp, Artificial
  Mutation in BnaC.FAD2.b introduced by TALE nuclease pair BnFAD2_T03
caggatccatgggtgcaggtggcctaatgcaagtctctcctccctccagctcccccgaaaccaaaaccctcaaacgcgtcccctgcgagacaccacccttcactcttagacctcaagaaagcaatcccacctcactgcttccaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41877 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcatctgggtcatagcccacgagtgcggccaccacgccttcagcgactac

SEQ ID NO: 41878 - DNA, 347 bp, Artificial
  Mutation in BnaC.FAD2.b introduced by TALE nuclease pair BnFAD2_T03
cattctccattttttcaggtggaagaatgcaagtctctcctccctctagctcccccggaaccgacaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctccctttcctcgcctggcccctctactgggcctgccaaggctgcgtcctaacgggcctcggggtcatcgcccacgaatgcggccaccgcgccttcagagactac

SEQ ID NO: 41879 - DNA, 370 bp, Artificial
  Mutation in BnaC.FAD2.b introduced by TALE nuclease pair BnFAD2_T03
caggatccatgggtgcaggtggaagaattcaagtctctcctccctccagctcccccggaaccaacaccatcaaacgcgtcccctgcgagacaccaccattcagggtcaagccgtgggcctggcacagcaccggcaacaggagacctcaagaaagcaatcccacctcactgcttcaaacgctccatcccacgctccttctcctcttcgacatcatcatctcctcctcggctcctccctctaccacctctccccagcctacttccctctcccttacctcgcctgacccctctactgggcctgccaaggctgcgtcctaacgggcctctgggtcatagcccacgagtgcggccaccacgccttcagcgactac

SEQ ID NO: 41880 - DNA, 335 bp, Artificial
  Mutation in BnaC.FAD2.b introduced by TALE nuclease pair BnFAD2_T03
caggatccatgggtgcaggtggaagaatgcaagtctctcctcccccagctcccccggaaccaacaccctcaaacgcgtcccctgcgagacaccaccattcacatgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41881 - DNA, 348 bp, Artificial
  Mutation in BnaC.FAD2.b introduced by TALE nuclease pair BnFAD2_T03
caggatccatgggtgcaggtggaagaatgcaagtctctcctccctccagctaccccgaaaccaaaaccctcaaacgcgtcccctgcgagacaccacccttcactcaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41882 - DNA, 358 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41883 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41884 - DNA, 335 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccagcacgccttcagcgactac

SEQ ID NO: 41885 - DNA, 385 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcaaatatttcttgtcaaaaatgctccactgacgttccataaattcccagacctcaagaaagcaatcccacctcactgcttcaaacgctccatcccacgctccttctcctcttcgacatcatcatctcctcctcggctcctccccctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41886 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatgctccttaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41887 - DNA, 447 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcctggagacggtccagcggctgttgccggtgctgtgccaggcccacggcttgaccccggagcaggtggtggccatcgccagccacgatggcggcgacctcaagaaagcaatcccaccccactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41888 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 41889 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcataacgggcctctgggtcatcgcccacgaatgcggccaccacgccttcagcgactac

SEQ ID NO: 41890 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 41891 - DNA, 332 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41892 - DNA, 330 bp, Artificial
  Mutation in BnaC.FAD2.b introduced by TALE nuclease pair BnFAD2_T03
caggatccatgggtgcaggtggcagaatgcaagtgtctactccctccaaaaagtctgaaaccgacaacatcaagcgcgtaccctgcgagacaccgacgggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41893 - DNA, 346 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgaactcaagaaagcaatcccacctcactgcttcaaacgctcaatccctcgctccttctcctacctcctcttcgacatcctcgtctcctcctccctctaccacctctccacagcctacttccctctcctcccccaccctctcccttacccccccgggccctctactgggcctgccaaggctgcgtcctaacgggcctctgggtcatagcccacgagtgcggccaccacgccttcagcgactac

SEQ ID NO: 41894 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41895 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 41896 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcttcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41897 - DNA, 351 bp, Artificial
  Mutation in BnaC.FAD2.b introduced by TALE nuclease pair BnFAD2_T03
caggatccatgggtgcaggtggcagaatgcaagtctatactccctccagctcccccgaaaccaaaaccatcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagtctacttccctctcctcccccaccctctcccttccctcgcctgacccctctactgggcctgccaaggctgcgtcctaacgggcctcggggtcatagcccacgagtgcggccaccacgccttcagcgactac

SEQ ID NO: 41898 - DNA, 404 bp, Artificial
  Mutation in BnaC.FAD2.b introduced by TALE nuclease pair BnFAD2_T03
caggatccatgggtgcaggtggcagaatgcaagtctatcctccctccagctcccccggaaccaacaccctcaaacgcgtcccctgcgagacaccacccttcactcttgctggcgatggccaccacctgctggggggtcaagccgtgggcctggcacagcaccggcaacagccgctggacccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcggcctaacgggcctctgggtcatcgcccacgaatgcggccaccacgccttcagcgactac

SEQ ID NO: 41899 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagaaagcaatcccacctcactgcttcaaacgctccatcccacgctccttctcctcttcgacatcatcatctcctcctcgtctcctcctccctctaccacctctccacagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 41900 - DNA, 424 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgactacggcgtgatcgtggacaccacgagcatcacaaaaatcgacgctcaagtcagaggtggcgaaaccccgcgacctcaagaaagcaatcccacctcactgcttcaaacgctccatcccacgctccttctcctcttcgacatcctcatctcctcctcggctcctccctctaccacctctccacagcctacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 41901 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcacacctcactgcttcaaacgctccacccctcgcgccttctcctacctcctcttcgacatccgcgtctcttcctccctctaccacctctccccagcctacttccctctcccccccctccctctcccttacctcgcctggcccctctactgggcctgccaaggctgcgtcctaaccggcctctgggtcatagcccacgagtgcggccaccacgccttcagcgactac

SEQ ID NO: 41902 - DNA, 337 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtgagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggactgccaaggctgcgtcctaacgggcctctgggtcatagcccacgagtgcggccaccacgccttcagcgactac

SEQ ID NO: 41903 - DNA, 331 bp, Artificial
  Mutation in BnaC.FAD2.b introduced by TALE nuclease pair BnFAD2_T03
caggatccatgggtgcaggtggcagaatgcaagtctctactccctccagctcccccgaaaccaaaaccctcaaacgcgtcccctgcgagacaccaccattcactcttacagcgagcgatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctggggcatagcccacgagtgcggccaccacgcctgcagcgactac

SEQ ID NO: 41904 - DNA, 472 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaccaccacctgctccggggtcaagccgtgggcctggcacagcaccggcaaacgttggcgtcggcaaacagtggtccggcgcacgcgctctggaggccttgctcacggtggcgggagagttgagagggagacctcaagaaagcaatcccacctcactgcttcaaacgctccacccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccacaacgccttcagcgactac

SEQ ID NO: 41905 - DNA, 356 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactttgctccaagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 41906 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccccgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactat

SEQ ID NO: 41907 - DNA, 329 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41908 - DNA, 420 bp, Artificial
  Mutation in BnaC.FAD2.b introduced by TALE nuclease pair BnFAD2_T03
caggatccatgggtgcaggtggcagaatgcaagtctctactccctccagctcccccggaaccaacaccctcaaacgcgtcccctgcgagacaccaccattcactctcggtgttgtgccaggcccacggcttgaccccggagcaggtggtggccatcgccagccacgatggcggcaacagccgctggacccagaccgcaagaaagcaatcccacctcactgcttcaaacgctccatcccacgctccttctcctcttcgacatcatcatcccctcctcggctcctccctctcccacctctccacagcctacttccctctcccttacctcgcctgacccctctactgggcctgccaaggctgcgtcctaacgggcctcggggtcatagcccacgagtgcggccaccacgccttcagcgactac

SEQ ID NO: 41909 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacacaacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41910 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaaagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41911 - DNA, 400 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgctagacaccacccttcactctggcaacgctgcgatcatgtcctgatacttgacagcgacggtccctatcgcagacctcaagaaagcaatcccacctcactgcttcaaacgctccatccctcgctccttctcctacctcctcttcgacatcctcgtctcctcctccccctaccacctctccacagcctacttccctccccgcccccaccctctcccttccctcgcctgacccctctactgggcctgccaaggctgcgtcctgacgggcctctggggcatagcccacgagtgcggccaccacgccttcagcgactac

SEQ ID NO: 41912 - DNA, 316 bp, Artificial
  Mutation in BnaC.FAD2.b introduced by TALE nuclease pair BnFAD2_T03
caggatccatgggtgcaggtagcagaatgcaagtctctcctccctcccgctcccccgaaaccaaaaccctcaaacgcgtcccctgcgagacaccacccttcactctcggcttcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41913 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccatcaaacgcgtcccctgcgagacaccccccttccctctagagaccacaagaaagcaatcccacctcactgcttcaaacgctccatccctcgctccttctcctacctccccttcgacatcctcgtccccccctccctctaccacctctccacagcctacttccctctccccccccaccctctcccttacctcgcctggcccctctactgggcctgccaaggctgcgtcctaacgggcctctgggtcatcgcccacgaatgcggccaccacgccttcagcgactac

SEQ ID NO: 41914 - DNA, 317 bp, Artificial
  Mutation in BnaC.FAD2.b introduced by TALE nuclease pair BnFAD2_T03
caggatccatgggtgcaggtggaagaatgcaagtctctcctccctcccgctcgcccgaaaccaaaaccctcaaacgcgtcccctgcgagacaccacccttcactctcggcttcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41915 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgaactcaagaaagcaatcccacctcactgcttcaaacgctccatcccacgctccttctcctcttcgacatcatcatctcctcctcgactcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41916 - DNA, 323 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacacctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41917 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcggagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41918 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacggagacctcaagaaagcaatcccacctcactacttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41919 - DNA, 350 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctaaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41920 - DNA, 342 bp, Artificial
  Mutation in BnaC.FAD2.b introduced by TALE nuclease pair BnFAD2_T03
caggatccatgggtgcaggtggaggaatgcaagtctctcctccctccagctcccccgaaaccaaaaccctcaaacgcgtcccctgcgagacaccacccttccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41921 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41922 - DNA, 341 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41923 - DNA, 384 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacggtccagcggctgttgccggtgctgtgccaggcccacggcttgaccccggagcaggtggtggccagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41924 - DNA, 317 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41925 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 41926 - DNA, 335 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctacccctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41927 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 41928 - DNA, 312 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaacgctccatcccacgctccttctcctcttcgacatcctcgtctcctcctccctctaccacctctccacagcctacttccctctcctcccccaccctctcccttacctcgcctgacccctctactgggcctgccagggctgcgtcctaaccggcgtctgggtcatagcccacgagtgcggccaccacgccttcagcgactac

SEQ ID NO: 41929 - DNA, 333 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcatcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgtgcctgccaaggctgcggcctaacgggcctctgggtcatagcccacgggtgcggccaccacgccttcagcgactac

SEQ ID NO: 41930 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcggcgactac

SEQ ID NO: 41931 - DNA, 348 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcatcgactac

SEQ ID NO: 41932 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 41933 - DNA, 329 bp, Artificial
  Mutation in BnaC.FAD2.b introduced by TALE nuclease pair BnFAD2_T03
caggatccatgggtgcaggtcgcagaatgcaagtgtctcctccctccaaaaagtctgaaaccgacaacatcaaacgcgtcccctgcgagacaccacccttcatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41934 - DNA, 350 bp, Artificial
  Mutation in BnaC.FAD2.b introduced by TALE nuclease pair BnFAD2_T03
caggatccatgggtgcaggtagaagaatgcaagtctctactcactcccgctcccccggacccaacaccctcaaacgcgtcccctgcgagacaccaccattcactcacctcaagaaagcaatcccacctcactgcttcaaacgctccatcccacgctccttctcctcttcgacatcatcatctcctcctcgtctcctcctacctctaccacctctccacagcctacttccctctcctcccccaccctctcccttacctcgccgggcccctctactgggcctgccaaggctgcttcctaacgggcctctgggtcatcgcccacgaatgcggcctccacgcctttgcgactac

SEQ ID NO: 41935 - DNA, 336 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41936 - DNA, 350 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41937 - DNA, 348 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccaccattcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgctac

SEQ ID NO: 41938 - DNA, 358 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactctccgccggagacctcaagaaagcaatcccacctcactgcttcaaacgctccatcccacgctccttctcctcttcgccatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41939 - DNA, 265 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgctcacgaatgcggccaccacgccttcagcgactac

SEQ ID NO: 41940 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaattccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41941 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgtagagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41942 - DNA, 281 bp, Artificial
  Mutation in BnaC.FAD2.b introduced by TALE nuclease pair BnFAD2_T03
caggatccatgggtgcaggtggaagaatgcaagtctctcatccctccaggtagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41943 - DNA, 382 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacagccgctggaccgtctccagcgcctgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtcctaaccggcgtctgggtcatagcccgcgagtgcggccaccacgccttcagcgactac

SEQ ID NO: 41944 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 41945 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactc

SEQ ID NO: 41946 - DNA, 343 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactctcggtcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41947 - DNA, 343 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtcggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41948 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggagacctcaagaaagcaatcccacctcactgcttcaaacgctccatcccacgctccttctcatcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41949 - DNA, 345 bp, Artificial
  Mutation in BnaC.FAD2.b introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcacaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41950 - DNA, 342 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41951 - DNA, 400 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctggcaacgctgcgatcatgtcccgatacttgacagcgacggtccctatcgcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41952 - DNA, 333 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccatcaaacgcgtcccctgcgagacaccaccattcactctcctcaagaaagcaatcccaacgcactgcttcaaacgctccatcccacgctcctcctcctcttcgacatcatcatctcctcctcggctcctccctctaccacctcaccacagcctccttccctctcccttacctcgcctggcccctctactgggcctgccaaggctgcgtcctaacgggcctctgggtcatagcccacgagtgcggccaccacgccttcagcgactac

SEQ ID NO: 41953 - DNA, 336 bp, Artificial
  Mutation in BnaC.FAD2.b introduced by TALE nuclease pair BnFAD2_T03
caggatccatgggtgcaggtggcagaatgcaagtctatactccctccagctcccccggaaccaacaccctcaaacgcgtcccctgctagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41954 - DNA, 317 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacctcaagaaagcaatcccacctcactgcttcaaacgctccatcccacgctccttctcctcttcgacatcatcatctcatcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41955 - DNA, 431 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctgttgccggtgctgtgccaggcccacggcttgaccccccagcaggtggtggccatcgccagcaatggcggtggcaagcaggcgctggagacggacctcaagaaagcaatcccacctcactgcttcaaacgctccatcccacgctccttctcctctccgacatcatcatctcctcctcggctcctccctctcccacctctccacagcctacttccctctcccttacctcgcctgacccctctactgggcctgccaaggctgcgtcctgacgggcctcggggtcatagcccacgagtgcgtccaccacgccttcagccactac

SEQ ID NO: 41956 - DNA, 334 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcgacctcaacaaagcaatcccacctcactgcttcaaactctccatcccaccctccttctcctcttcgacatcatcatctcctcctccgctcctccctctcccacctccccacagcctacttccctctcccttacctcgcctgacccctctactgggcctgccaaggctgcgtcctaacgggcctctgggtcatagcccacgagtgcggccaccacgccttcagcgactac

SEQ ID NO: 41957 - DNA, 349 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctccattacctcgcctggcccctctactgggcctgccaaggctgcgtcctaacgggcctctgggtcatcgcccacgaatgcggccaccacgccttcagcgactac

SEQ ID NO: 41958 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacacacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 41959 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctacctcatctgggacatcatcatagcctcctgcttctactgcgtccaccacttacttccctctcctccctcaccctctctcctacttcgcctggcctctctactgggcctgccaaggctgcgtcctaacgggcctctgggtcatcgcccacgagtgcggccaccacgccttcagcgactac

SEQ ID NO: 41960 - DNA, 349 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccatcaaacgcgtcccctgcgagacaccacccttcactgagacctcaagaaagcaatcccacctcactgcttcaaacgctccatccctcgctccttctcctacctcctcttcgacatcctcgtcgcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 41961 - DNA, 323 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 41962 - DNA, 308 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 41963 - DNA, 337 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41964 - DNA, 336 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactctaaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41965 - DNA, 264 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttcgacatcctcgtctcctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 41966 - DNA, 337 bp, Artificial
  Mutation in BnaC.FAD2.b introduced by TALE nuclease pair BnFAD2_T03
caggatccatgggtgcaggtggaagaatgcaagtctctcctccctcccgctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 41967 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcttagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41968 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgccccatcccccaccccttctcctacctccccttcgccatccccgtctccccctccctctaccacctctccccagcctacttccctctccccccccaccctctcccttaccccgcccggcccctctactgggcctgccaaggctgcgtcctaacgggcctctgggtcatcgcccacgaatgcggccaccacgccttcagggactac

SEQ ID NO: 41969 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 41970 - DNA, 344 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccacccttcactctcggaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 41971 - DNA, 317 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacatcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41972 - DNA, 350 bp, Artificial
  Mutation in BnaC.FAD2.b introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41973 - DNA, 333 bp, Artificial
  Mutation in BnaC.FAD2.b introduced by TALE nuclease pair BnFAD2_T03
caggatccatgggtgcaggtggcagaatgcaagtctctactccctccagctcccccggaaccaacaccctcaaacgcgtcccctgcgagacaccaccattcactctcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41974 - DNA, 350 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccaccattcactcgagacctcaagaaagcaatcccaccgcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatagcccacgagtgcggccaccacgcctgcagcgactac

SEQ ID NO: 41975 - DNA, 334 bp, Artificial
  Mutation in BnaC.FAD2.b introduced by TALE nuclease pair BnFAD2_T03
caggatccatgggtgcaggtggaagaatccaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41976 - DNA, 372 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcgggttccatagcgttaaggtttcatttagcgcctcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 41977 - DNA, 280 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41978 - DNA, 306 bp, Artificial
  Mutation in BnaC.FAD2.b introduced by TALE nuclease pair BnFAD2_T03
caggatccatgggtgcaggtggaagaatgcaagtctatcctccctcccgctcccccgaaaccaaaaccctcaaacgcaatcccaactcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41979 - DNA, 347 bp, Artificial
  Mutation in BnaC.FAD2.b introduced by TALE nuclease pair BnFAD2_T03
caggatccatgggtgcaggtggcagaatgcaagtgtctactccctccaaaaagtctgaaaccgacaacatcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgcctgcagcgactac

SEQ ID NO: 41980 - DNA, 343 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggcggagaactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41981 - DNA, 391 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaagcgcgtaccctgcgagacaccacccttcactctaggcgacgaggtggtcgttggtcaacgcggccaacgccgggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41982 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgattgcggccaccacgccttcagcgactac

SEQ ID NO: 41983 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacatcacccttcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41984 - DNA, 354 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactctcgggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 41985 - DNA, 321 bp, Artificial
  Mutation in BnaC.FAD2.b introduced by TALE nuclease pair BnFAD2_T03
caggatccatgggtgcaggtggcagaatgcaagtctctcctcactccagctcccccggaaccaacaccctcaaacgcgtcccctgcgagcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41986 - DNA, 341 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctacctcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 41987 - DNA, 436 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgcgttgccttggtaggtccagcggcggaggaactctttgatccggttcctgaacaggatctatttgaggcgctaaatgaaaccttagacctcaagaaagcaatcccacctcactgcttcaaacgctccatccctcgctccttctcctacctcctcttcgacatccgcgtctccgcctccctctaccaccgctccacagcctacttccctctcctcccccaccctctcccttgcctcgcctggcccctctactgggcctgccaaggctgcgtcctaacgggcctctgggtcatagcccacgagtgcggccaccacgccttcagcgactac

SEQ ID NO: 41988 - DNA, 342 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggcggcgtcctaacgggcctctgggtcatcgcccacgaatgcggccaccacgccttcagcgactac

SEQ ID NO: 41989 - DNA, 292 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 41990 - DNA, 334 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaaactcaagaaagcaatcccaccgcactgtttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41991 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgacctcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 41992 - DNA, 350 bp, Artificial
  Mutation in BnaC.FAD2.b introduced by TALE nuclease pair BnFAD2_T03
caggatccatgggtgcaggtggaagaatgcaagtatctcctccctccagctcccccgaaaccaaaaccctcaaacgcgtccactgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 41993 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 41994 - DNA, 413 bp, Artificial
  Mutation in BnaC.FAD2.b introduced by TALE nuclease pair BnFAD2_T03
caggatccatgggtgcaggtggaagaatgcaagtctctactcactccagctcccccggaaccaacaccctcaaacgcgtcccctgcgagacaccaccattccgctggaccgtctccagcgcctgcttgccaccgccattgctggcgatggccaccacctgctggggggtcaagccgtgggcctagacctcaagaaagcaatcccacctcactgcttcaaacgctccatcccacgctccttctcctcttcgacatcatcatctcctcctcgtctcctccccctcccacctctccacagcctacttccctctcccttacctcgcctgacccctctactgggcctgccaaggctgcgtcctaacgggcctctggggcatagcccgcgagtgcgtccaccacgccttcagcgactac

SEQ ID NO: 41995 - DNA, 330 bp, Artificial
  Mutation in BnaC.FAD2.b introduced by TALE nuclease pair BnFAD2_T03
caggatccatgggtgcaggtggaagaatgcaagtctctactccatccagctcccccggaaccaacaccctcaaacgcgtcccctgcgagacaccaccattagacctcaagaaagcaatcccacctcactgcttcaaacgctccatcccacgctccttctcctcttcgacatcatcatctcctcctcgactcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 41996 - DNA, 339 bp, Artificial
  Mutation in BnaC.FAD2.b introduced by TALE nuclease pair BnFAD2_T03
caggatccatgggtgcaggtggaagaatgcaagtctctactccctcgagctcccccggaaccaacaccctcaaacgcgtcccctgcgagacaccaccattcaagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 41997 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactagacctcaagaaagcaatcccacctcactgcttcaaacgctccctcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccactccttcagcgactac

SEQ ID NO: 41998 - DNA, 345 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcttggtcatcgcccacgaatgcggccaccacgccttcagcgactac

SEQ ID NO: 41999 - DNA, 306 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42000 - DNA, 336 bp, Artificial
  Mutation in BnaC.FAD2.b introduced by TALE nuclease pair BnFAD2_T03
caggatccatgggtgcaggtgtaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcgactcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42001 - DNA, 346 bp, Artificial
  Mutation in BnaC.FAD2.b introduced by TALE nuclease pair BnFAD2_T03
caggatccatgggtgcaggtggaagaatgcaagtctctactccctccagctcccccgagaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42002 - DNA, 356 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggggagacctcaagaaagcaatcccacctcactgcttcaaacgctccatccctcgctccttctcctacctcctcttcgacatcctcgtctcctcctacctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42003 - DNA, 331 bp, Artificial
  Mutation in BnaC.FAD2.b introduced by TALE nuclease pair BnFAD2_T03
caggatccatgggtgcaggtggcagaatgcaagtgtctactcactccagctcccccgaaaccaaaaccctcaaacgcgtcccctgcgagacaccacccttcacgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccgcgagtgcggccaccacgccttcagcgactac

SEQ ID NO: 42004 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccacaacgccttcagcgactac

SEQ ID NO: 42005 - DNA, 350 bp, Artificial
  Mutation in BnaC.FAD2.b introduced by TALE nuclease pair BnFAD2_T03
caggatccatgggtgcaggtggaagaatgcaagtctctcctccctcaagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaatgctgcgtcctaacgggcctctgggtcatcgcccacgaatgcggccaccacgccttcagcgactac

SEQ ID NO: 42006 - DNA, 334 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42007 - DNA, 349 bp, Artificial
  Mutation in BnaC.FAD2.b introduced by TALE nuclease pair BnFAD2_T03
caggatccatgggtgcaggtggaagaatgcaagtctctactccctctagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagcctgcgtcctaacgggcctctgggtcatcgcccacgaaggcggccaccacgccttcagcgactac

SEQ ID NO: 42008 - DNA, 354 bp, Artificial
  Mutation in BnaC.FAD2.b introduced by TALE nuclease pair BnFAD2_T03
caggatccatgggtgcaggtggcagaatgcaagtctatactccctccagctcccccggaaccaacaccctcaaacgcgtcccctgcgagacaccaccattcactctcgggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttccctcccctggcccctctactgggcctgccaaggctgcgtcctaacgggcctctgggtcatagcccacgagtgcggccaccacgcctgcagcgactac

SEQ ID NO: 42009 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccatcaaacgcgtcccctgcgagacaccacccttcactcgacctcaagaaagcaatcccacctcactgcttcaaacgctccatccctcgctccttctcctacctcctcttcgacatcctcgtctcctcatccctctaccacctcgccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42010 - DNA, 370 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtggataaccgtattaccgcctttgagtgagctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 42011 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatcccacgctccttctcctcttcgacatcatcatctcctcctcggctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 42012 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42013 - DNA, 265 bp, Artificial
  Mutation in BnaC.FAD2.b introduced by TALE nuclease pair BnFAD2_T03
caggatccatgggtgcaggtggaagaatgtaagtctctcctccctccagtctctccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42014 - DNA, 333 bp, Artificial
  Mutation in BnaC.FAD2.b introduced by TALE nuclease pair BnFAD2_T03
caggatccatgggtgcaggtggaagaatgcaagtctctcctacctccagctcccccgaaaccaaaaccctcaaacgcgtcccctgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42015 - DNA, 325 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 42016 - DNA, 345 bp, Artificial
  Mutation in BnaC.FAD2.b introduced by TALE nuclease pair BnFAD2_T03
caggatccatgggtgcaggtggcagaatgcaagtctctactccctccagctcccccgaaaccaaaaccctcaaacgcgtcccctgcgagacaccacccttcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42017 - DNA, 358 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctcgttcaaatccgcacccggcgcctttgtcctactcaggtgaacgcgacctcacgcaagcactcccacctcactgcttcaaacgctccatccctcgctccttctcctcttcggcatcatcatctcctcctcggctcctccctcaccctctctcctacttcgcctggcctctctactgggcctgccagggctgcgtcctaacgggcctctgggtcatcgcccacgaatgcggccaccacgccttcagcgactac

SEQ ID NO: 42018 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 42019 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccatgacagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42020 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggacccaaccccttcaaccccgtcccctgcgagaaccccccattcccactgacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 42021 - DNA, 317 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42022 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctccatccctcgctccttctcctacctcctcttctacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42023 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggcaaccacgccttcagcgactac

SEQ ID NO: 42024 - DNA, 295 bp, Artificial
  Mutation in BnaC.FAD2.b introduced by TALE nuclease pair BnFAD2_T03
caggatccatgggtgcaggtggaagaatgcaagtctctcatccctccaggtagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42025 - DNA, 385 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcggcctttttacggttcctggccttttgctggccttttgctcacatgttctttcctgcgttatcccccgggagacctcaagaaagcaatcccacctcactgcttcaaacgctccatccctcgctccttctcctacctcctcttcgccatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42026 - DNA, 349 bp, Artificial
  Mutation in BnaC.FAD2.b introduced by TALE nuclease pair BnFAD2_T03
caggatccatgggtgcaggtggcagaatgcaagtctgtcatccctccagctcccccggaaccaacaccctaaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccatgagtgcggccgaaccggcgtctgggtcatagcccacgagtgcggccaccacgcctccagcgactac

SEQ ID NO: 42027 - DNA, 395 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgccccctggcttgaccccggagcaggtggtggccatcgccagccacgatggcggcaacagccgctggaccgagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42028 - DNA, 366 bp, Artificial
  Mutation in BnaC.FAD2.b introduced by TALE nuclease pair BnFAD2_T03
caggatccatgggtgcaggtggcagaatgcaagtctatactcactccagctcccccggaaccaacaccctcaaacgcgtcccctgcgagacaccaccattcactatcaggggataacgcaggaaagaacatgtgagcaaaaggccagcaaatctaccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtcggggtcttagcccgcgagtgcggcctccacgccttcagcgactac

SEQ ID NO: 42029 - DNA, 300 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 42030 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 42031 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagagacctcaagaaagcaataccacctcactgcttcaaacgcgccatctcacgctccttctcctcttcgacatcatcatctcctcctcggctcctccctcgcccacctccccacagcctccttccctctcccttacctcgcctggcccctctactgggcctgccaaggctgcgtcctaacgggcctctgggtcatagcccacgagtgcggccaccacgccttcagcgactac

SEQ ID NO: 42032 - DNA, 265 bp, Artificial
  Mutation in BnaC.FAD2.b introduced by TALE nuclease pair BnFAD2_T03
caggatccatgggtgcaagcggaagaatgcaagtctctcctccctccagtctctccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42033 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacaagaaagcagtcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccatcacgccttcagcgactac

SEQ ID NO: 42034 - DNA, 358 bp, Artificial
  Mutation in BnaC.FAD2.b introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtcggaagaactcaagaaagcaatcccacctcactgcttcaaacgctccatccctcgctccttctcctcttcgacatcatcatctcctcctcgtctcctcctccctctaccacctctccacagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 42035 - DNA, 349 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatagcccacgagtgcggccaccacgccttcagcgactac

SEQ ID NO: 42036 - DNA, 274 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccgcgccttcagcgactac

SEQ ID NO: 42037 - DNA, 331 bp, Artificial
  Mutation in BnaC.FAD2.b introduced by TALE nuclease pair BnFAD2_T03
caggatccatgggtgcaggtggaagaatgcaagtgtataatccctccaaaaagtctgaaaacgacaacatcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgtgcctgccaaggctgcgtcctaacgggcctctgggtcatagccctcgagtgcgtccaccacgccttcagcgactac

SEQ ID NO: 42038 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcacctggcccctctacggggcctgccaaggctgcgtcctaacgggcgtctgggtcatagcccacgagtgcggccaccacgccttcagcgactgc

SEQ ID NO: 42039 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcactccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatcgcccacgaatgcggccaccacgcctccaccgactac

SEQ ID NO: 42040 - DNA, 334 bp, Artificial
  Mutation in BnaC.FAD2.b introduced by TALE nuclease pair BnFAD2_T03
catgatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacatcctacttccctctcccttacctcgcctgacccctctactgggcctgccaaggctgcgtcctaacgggcctctgggtcatagcccacgagtgcggccaccacgccttcagcgactac

SEQ ID NO: 42041 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcctacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 42042 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctacgagacggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42043 - DNA, 346 bp, Artificial
  Mutation in BnaC.FAD2.b introduced by TALE nuclease pair BnFAD2_T03
caggatccatgggtgcaggtggaagaatgcaagtctatactccctccagctcccccgaaaccaaaaccctcaaacgagtcccctgcgagacaccacccttcacgacctcaagaaagcaatcccaccgcactgtttcaaacgctcgatccctcgctctttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 42044 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcaagaaagcaatcccacctcactgcttcaaacgctccatcccatgctccttctcctacctcctcttcgacatcctcgtctcctcctccctctaccacctctccacagcctacttccctctcctcccccaccctctcccttacctcgcctggcccctctactggtcctgccaaggctgcggcctaacgggcctctgggtcatcgcccacgaatgcggccaccacgccttcatcgactac

SEQ ID NO: 42045 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaacgggcctctgggtcatagcccacgagtgcggccaccacgccttcagcgactac

SEQ ID NO: 42046 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatcgcccgcgaatgcggccaccacgcctgcagcgactac

SEQ ID NO: 42047 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagacctcaagaaagcaatcccacctcactgcttcaaacgctccatccctcgctccttctcctacctcctcttcgacctcctcgtctcctcctccctctaccacctctccacaccctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42048 - DNA, 350 bp, Artificial
  Mutation in BnaC.FAD2.b introduced by TALE nuclease pair BnFAD2_T03
caggatccatgggtgcatgtcgaagaatgcaagtatctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42049 - DNA, 350 bp, Artificial
  Mutation in BnaC.FAD2.b introduced by TALE nuclease pair BnFAD2_T03
caggatccatgggtgcaggtggcagaatgcaagtctatactccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcttcgcccacgaatgcggccaccacgcctgcagcgactac

SEQ ID NO: 42050 - DNA, 406 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgggcctggcacagcaccggcaacagccgctggaccgtctccagcgcctgcttgcgagacctcaagaaagcaaccccacctcactgcttcaaacgctccatccctcgctccttctcctacctcctcttcgacatcctcgtctcctcctccctctaccacctccccacagcctccttccctctcctcccccaccctctccctttccccgcctggcccctctactgggcctgccaaggctgcgtcctaacgggcctctgggtcatcgcccacgaatgcggccaccacgccttcagcgactac

SEQ ID NO: 42051 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaggaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42052 - DNA, 349 bp, Artificial
  Mutation in BnaC.FAD2.b introduced by TALE nuclease pair BnFAD2_T03
caggatccatgggtgcaggcagaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggcggcgtcctaacgggcctctgggtcatagcccacgagtgcggccaccgcgcctgcagcgactac

SEQ ID NO: 42053 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 42054 - DNA, 372 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgccggtgctgtgccaggcccagacctcaagaaagcaatcccacctcactgcttcaaacgctccatcccacgctccttctcctcttcgacatcatcatctcctcctcggctcctccctctaccacctctccacagcctacttccctctcctcccccaccctctcccttccctcgcctgacccctctactgggcctgccaaggctgcgtcctaacgggcctctgggtcatagcccacgagtgcggccaccacgccttcagcgactac

SEQ ID NO: 42055 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcgtcgacatcatcatctcctcctcggctcctccctctaccacctctccacagcctactcccctctcccttacctcgcctgacccctctactgggcctgccaaggctgcgtcctaacgggcctctgggtcatagcccacgagtgcggccaccacgccttcagcgactac

SEQ ID NO: 42056 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagggcggccaccacgccttcagcgactac

SEQ ID NO: 42057 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtaccctgcgagacaccgcccttcactgactcaagaaagcaatcccaccgcactgtttcaaacgctcgatccctcgctctttctcctacctcatctgggacatcatcatagcctcctgcttctaccacctctccacagcctacttccctctcctcccccaccctctcccttacctcgcctggcccctctactgggcctgccaaggctgcgtcataacgggcctctgggtcatcgcccacgaatgcggccaccacgccttcagcgactac

SEQ ID NO: 42058 - DNA, 349 bp, Artificial
  Mutation in BnaC.FAD2.b introduced by TALE nuclease pair BnFAD2_T03
caggatcatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42059 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccccccttaaagacctcaagcaagcaatcccacctcactgcttcaaacgctccatcccacgccccttctcctcttcgccatcatcatctcctcctcctctcctccctctaccacctctccacagcctccttccctctcccttacctcgcctgacccctctactgggcctgccaaggctgcgtcctaacgggcctctgggtcatagcccacgaatgcggccaccacgccttcagcgactac

SEQ ID NO: 42060 - DNA, 351 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaacatcaagcgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42061 - DNA, 393 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctcgttgtgaagcaacggcccggagggtggcgggcaggacgcccgccataaactgccggagacctcaagaaagcaatcccacctcactgcttcaaacgctccatcccacgctccttctcctcttcgacatcatcatctcctcctcggctcctccctctaccacctcgccacagcctacttccctctcccttacctcgcctgacccctctactgggcctgccaaggctgcgtcctaacgggcctctgggtcatagcccacgagtgcggccaccacgccttcagcgactac

SEQ ID NO: 42062 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggttgcgtcctaacgggcctctgggtcatagcccacgagtgcggccaccacgccttcagcgactac

SEQ ID NO: 42063 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctcaccctctctcctacttccctctcccttacctcgcctgacccctctactgggcctgccaaggctgcgtcctaacgggcctctgggtcatagcccacgagtgcggccaccacgccttcagcgactac

SEQ ID NO: 42064 - DNA, 335 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactcggacctcaagaaagcaatcccacctcactgcttcaaacgctcaatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42065 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccagccaaggctgcgtcctaaccggcgtctgggtcatagcccacgagtgcggccaccacgccttcagcgactac

SEQ ID NO: 42066 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcttcctaacgggcctctgggtcatagcccacgagtgcggccaccacgccatcagcgactac

SEQ ID NO: 42067 - DNA, 349 bp, Artificial
  Mutation in BnaC.FAD2.b introduced by TALE nuclease pair BnFAD2_T03
caggatccatgggtgcaggtcgaagaatgcaagtctctcctccccccagctcccccggaaccaacaccatcaaacgcgtcccctgcgagacaccaccattcactagacctcaagaaagcaatcccacctcattgcttcaaacgctccatcccacgctccttctcctcttcgacatcatcatctcctcctcggctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 42068 - DNA, 319 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 42069 - DNA, 324 bp, Artificial
  Mutation in BnaC.FAD2.b introduced by TALE nuclease pair BnFAD2_T03
caggatccatgggtgcaggcggaagaatgcaagtctctactccaacaacaccctcaaacgcgtcccctgcgagacaccaccattcactctcgggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 42070 - DNA, 342 bp, Artificial
  Mutation in BnaC.FAD2.b introduced by TALE nuclease pair BnFAD2_T03
caggatccatgggtgcaggtggaagaatgcaagtctatactccctccagctcccccggaaccaacaccctcaaacgcgtcccctgcgagacaccaccattcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccgcgaatgcggccaccacgccttcagcgactac

SEQ ID NO: 42071 - DNA, 346 bp, Artificial
  Mutation in BnaC.FAD2.b introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42072 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 42073 - DNA, 349 bp, Artificial
  Mutation in BnaC.FAD2.b introduced by TALE nuclease pair BnFAD2_T03
caggatccatgggtgcaggtggaagaatgcaagtctctcctcactccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 42074 - DNA, 413 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagactccaccattccgctggaccgtctccagcgcctgcttgccaccgccattgctggcgatggccaccacctgctggggggtcaagccgtgggcctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42075 - DNA, 332 bp, Artificial
  Mutation in BnaC.FAD2.b introduced by TALE nuclease pair BnFAD2_T03
caggatccatgggtgcagggggaagaatgcaagtctcttctccctctcgctcacccggagccaacaccttcaaacgagtccccagcgagacaccaccattcaagacctcaagaaagcaatcccacctcactgcttcaaacgctccatcccacgctccttctcctcttcgacatcatcatctcctcctcggctcctccctctaccacctctccacagcctacttccctcgcccttacctcgcctgacccctctactgggccggccaaggctgcgtccatacgtgcctcttggacatagcccacgatggcggcgaccgctccttcatcgactac

SEQ ID NO: 42076 - DNA, 317 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctgacgggcctctgggtcagagcccacgagtgcggccaccacgcctgcattgactac

SEQ ID NO: 42077 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgacctcaagaaagcaatcccacctcactgcttcaaacttctcctcttcgacatcatcatctcctcctcggctcctccctctaccacctctccacagcctacttccctctcccttacctcgcctgacccctctactgggcctgccaagcctgcgtcctaacgggcctctgggtcatagcccacgagtgcggccaccacgccttcagcgactaa

SEQ ID NO: 42078 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgtgtcccctgcgagacaccacccttcactctagaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42079 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaacgggcctctgggtcatagcccacgagtgcggccaccacgccttcagcggctac

SEQ ID NO: 42080 - DNA, 331 bp, Artificial
  Mutation in BnaC.FAD2.b introduced by TALE nuclease pair BnFAD2_T03
caggatccatgggtgcaggtggaagaatgcaagtctctcttccctccagctcccccggaaccaacaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggtccctctactgggcctgccaaggctgcgtcctaacgggcctctgggtcatcgcccacgaaggcggccaccacgccttcagcgactac

SEQ ID NO: 42081 - DNA, 336 bp, Artificial
  Mutation in BnaC.FAD2.b introduced by TALE nuclease pair BnFAD2_T03
caggatccatgggtgcaggtggaagaatgcaagtatatactccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42082 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaaccggcgtctgggtcatagcccacgagtgcggccaccacgccttcagcgactac

SEQ ID NO: 42083 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcacaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 42084 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42085 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatgctccttaagaaagcaatcccacctcactgcttcaaacgctccatcccacgctccttctcctcttcgacatcatcatctcctcctcggctcctccctctaccacctctccacagcctacttccctctcccttgcctcgcctgacccctctactgggcctgccaaggctgcgtcctaacgggcctctgggtcatagcccacgagtgcggccaccacgccatcagcgactac

SEQ ID NO: 42086 - DNA, 325 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcactgtttcaaacgctcgatccctcgctctttctcctacctcctcttcgacatcctcgtctcctcctccctctaccacctctccacagcctacttccctctcctcccccaccctctcccttacctcgcctggcccctctactgggccggccaaggctgcgtccgaacgggcctctgggtcatcgcccacgaatgtggccaccacgccttcagcgactac

SEQ ID NO: 42087 - DNA, 395 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactagttgccggtgctgtgccaggcccacggcttgaccccccagcaggtggtggccatcgccagcagacctcaagaaagcaatcccacctcactgcttcaaacgctccatccctcgctccttctcctacctcctcttcgacatcctcgtctcctcctacctctaccacctctccacagcctacttccctctcccttacctcgcctgacccctctactgggcctgccaaggctgcgtccgaacgggcctctgggtcatagcccacgagtgcggccaccacgccttcagcgactac

SEQ ID NO: 42088 - DNA, 318 bp, Artificial
  Mutation in BnaC.FAD2.b introduced by TALE nuclease pair BnFAD2_T03
caggatccatgggtgcaggcggcagaatgcaagtatctcatccctcaagctcccccgaaaccaaaaccctcaaacgcgtcccctgcgagacaccacccttcactatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42089 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaacgctccatcccacgctccttctcctcttcgacatcatcatctcctcctaggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42090 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctccctcctcttcgacatcctcgtctcctcctccctctaccacctctccacagcctacttccctctcctcccccaccctctccctgacctcgccgggcccctatactgggccagccaaggcggcgtcctaacgggcctctgggtcatcgcccacgaatgcggccaccacgccttcagcgactac

SEQ ID NO: 42091 - DNA, 392 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactctctccagcgcctgcttgccaccattattgctggcgatggccaccacctgctggggggagacctcaagaaagcaatcccacctcactgcttcaaacgctccatcccacgctccttctcctcttcgacatcatcatctcctcctcggctcctccccctcccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 42092 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaaacaatcccacctcactgcttcaaacgctccatccctcgctccttctcctacctcctcttcgacatcctcgtctcctcctccctctaccacccctccacatcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42093 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 42094 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42095 - DNA, 315 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaactcctccctcggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 42096 - DNA, 347 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgcctgcagcgactac

SEQ ID NO: 42097 - DNA, 337 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgcaagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42098 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42099 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcacctcaagaaagcaatcccacctcactgcttcaaacgctccatccctcgctccttctcctcttcgacatcatcatctcctcctcggctcctccctctaccacctctccacagcccacttccctctcccttacctcgcctgacccctctactgggcctgccaagggtgcgtcctaaccggcgtctgggtcatagcccacgagtgcggccaccacgccttcagcgactac

SEQ ID NO: 42100 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 42101 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacccccaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgtgtcatcgcccacgaatgcggccaccacgccttcagcgactac

SEQ ID NO: 42102 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42103 - DNA, 291 bp, Artificial
  Mutation in BnaC.FAD2.b introduced by TALE nuclease pair BnFAD2_T03
caggatccatgggtgcaggtggaagaatgcaagtctctcctctcggagacctcaagaaagcaatcccacctcactgcttcaaacgctccatcccacgctccttctcctcttcgacatcatcatctcctcctcggctcctccctctaccacctctccacagcctacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 42104 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42105 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttagcgactac

SEQ ID NO: 42106 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgaatgcggccaccacgccttcagcgactac

SEQ ID NO: 42107 - DNA, 350 bp, Artificial
  Mutation in BnaC.FAD2.b introduced by TALE nuclease pair BnFAD2_T03
caggatccatgggtgcaggtggaagaatgcaagtatatcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42108 - DNA, 334 bp, Artificial
  Mutation in BnaC.FAD2.b introduced by TALE nuclease pair BnFAD2_T03
caggatccatgggtgcaggtggcagaatgcaagtgtctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcgactcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 42109 - DNA, 350 bp, Artificial
  Mutation in BnaC.FAD2.b introduced by TALE nuclease pair BnFAD2_T03
caggatccatgggtgcaggtggcagaatgcaagtctctactccctccagctcccccgaaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42110 - DNA, 246 bp, Artificial
  Mutation in BnaC.FAD2.b introduced by TALE nuclease pair BnFAD2_T03
caggatccatgggtgcaggtggcagaatgcaagtgtctcctccctccaaaaagtctgaaaccgacaacatcaagcgcgtaccctgcgagacaccacccttaccacctctccacagcctacttccctctcctcccccaccctctcccttacctctcctggcccctctactgggcctgccaaggctgcgtcctaacgtgcctctgggtcatcgcccgcgaatgcggcctccacgccttcagcgactac

SEQ ID NO: 42111 - DNA, 434 bp, Artificial
  Mutation in BnaC.FAD2.b introduced by TALE nuclease pair BnFAD2_T03
caggatccatgggtgcaggtggaagaatgcaagtctatactccctccagctcccccggaaccaacaccctcaaacgcgtcccctgcgagacaccaccattcactctcggcaacagccgctggaccgtctccagcgcctgcttgccaccattattgctggcgatggccaccacctgccatcccacgttccagacctcaagaaagcaatcccacctcactgcttcaaacgctccatcccacgctccttctcctctccgccctcctcatctcctcctcgcctcctccctctaccccctctccacagcctacttccctctcctcccccaccctctcccttacctcgcctggcccctctactgggcctgccaaggctgcggcctaacgggcctctgggtcatagcccacgagtgcggccaccacgcctgcatcgactac

SEQ ID NO: 42112 - DNA, 350 bp, Artificial
  Mutation in BnaC.FAD2.b introduced by TALE nuclease pair BnFAD2_T03
caggatccatgggtgcaggtggaagaatgcaagtctctactccctcaagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtccgaacgggcctctgggtcatcgcccacgaatgcggccaccacgccttcagcgactac

SEQ ID NO: 42113 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcttggtcatagcccacgagtgcggccaccacgccttcagcgactac

SEQ ID NO: 42114 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctacgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42115 - DNA, 310 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42116 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 42117 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 42118 - DNA, 323 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacacctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42119 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctccatcccacctcactgcttcaaacgctccatccctcgctccttctcctacctcctcttcgacatcctcgtctcctcctccctctaccacctcgccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42120 - DNA, 349 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctccctttcctcgcctggcccctctactgggcctgccaaggctgcgtcctaacgggcctctgggtcatcgcccacgaatgcggccaccacgccttcagcgactac

SEQ ID NO: 42121 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgaacctcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42122 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagcggagacctcaagaaagcaatcccacctcactgcttcaaacgctccatcccaccctccttctcctctccgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 42123 - DNA, 355 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctcctccctctaccacctctccacagcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 42124 - DNA, 344 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42125 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacaagtgcggccaccacgccatcagcgactac

SEQ ID NO: 42126 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcatcccacctcactgcttcaaacgctccatccctcgctccttctcctacctcctcttcgacctcctcgtctcctcctccctctaccacctctccacagcctacttccctctcctcccccaccctctcccttacctcgcctgacccctctactgggcctgccagggctgcgtcctaacgggcctctgggtcatcgcccacgaatgcggccaccacgccttcagcgactac

SEQ ID NO: 42127 - DNA, 336 bp, Artificial
  Mutation in BnaC.FAD2.b introduced by TALE nuclease pair BnFAD2_T03
caggatccatgggtgcaggtggaagaatgcaagtatctactccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42128 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 42129 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggatgcgtcctaaccggcgtctgggtcatagcccacgagtgcggccaccacgccttcagcgactac

SEQ ID NO: 42130 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggcggcggccgaacgggcctctgggtcatcgcccacgaatgcggccaccacgccttgagcgactac

SEQ ID NO: 42131 - DNA, 392 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccaccattcactcttgggcctggcacagcaccggcaacagccgctggaccgtctccagcgcctgcttgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgctttcagcgactac

SEQ ID NO: 42132 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 42133 - DNA, 389 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgctggcgatggccaccacctgctggggggtcaagccgtgggcctggcacagcaccggcaacagccgcaatcccacctcactgcttcaaacgctccatcccacgctccttctcctcttcgacatcatcatctcctcctcggctcctccctctcccacctctccacagcctacttccctctcccttccctcgcctgacccctctactgggcctgccaaggctgcgtcctaacgggcctctgggtcatagcccacgagtgcggccaccacgcctgcagcgactac

SEQ ID NO: 42134 - DNA, 339 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42135 - DNA, 301 bp, Artificial
  Mutation in BnaC.FAD2.b introduced by TALE nuclease pair BnFAD2_T03
caggatccatgggtgcaggtggaagaatgcaagtctctcctccctcccgtccccccggaaacaacaccctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42136 - DNA, 330 bp, Artificial
  Mutation in BnaC.FAD2.b introduced by TALE nuclease pair BnFAD2_T03
caggatccatgggtgcaggtggcagaatgcaagtctatcctccctccagctcccccgaaaccaaaaccctcaaacgcgtcccctgcgagacaccacccttcactcctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42137 - DNA, 363 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgcgatggcggcaagcaggcgctggagaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42138 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgtgcctctgggtcatcgcccacgaaggcggccaccacgccttcaacgactac

SEQ ID NO: 42139 - DNA, 328 bp, Artificial
  Mutation in BnaC.FAD2.b introduced by TALE nuclease pair BnFAD2_T03
caggatccatgggtgcaggtggaagaatgcaagtctctcctccctcccgctcccccggaaccaacaccctcaaccgcgtcccctgcgagacaccaccattcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagggcggccaccacgccttcagcgactac

SEQ ID NO: 42140 - DNA, 335 bp, Artificial
  Mutation in BnaC.FAD2.b introduced by TALE nuclease pair BnFAD2_T03
caggatccatgggtgcaggtggaagaatgcaagtgtctcctccctacaagaagtctgaaaccgacaccatcaagcgcgtaccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42141 - DNA, 313 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccaccattcactcagacctcaagaaagcaatcccacctcactgcttcaaacgctccatcccacgctccttctcctcttcgccatcatcatctcctcctcggctcctccctcaccctctctcctacttcgcctggcctctctactgggcctgccaagggtgcgtcctaaccggcgtctgggtcatagcccacgtgtgcggcctccgcgccatcaacgactac

SEQ ID NO: 42142 - DNA, 379 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctcggcttgaccccggagcaggtggtggccatcgccagccacgatggcggcaacagccgctggaccagacctcaagaaagcaatcccacctcactgcttcaaacgctccatcccacgctccttctcctcttcgacatcatcatctcctcctcggctcctccctctaccacctctcctacttcgcctggcctctctactgggcctgccaagggtgcgtcctaaccggcgtctgggtcatagcccacgagtgcggccaccacgccttcagcgactac

SEQ ID NO: 42143 - DNA, 342 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccaccattcactgagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42144 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaaacaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42145 - DNA, 387 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttgcccgccaccctccgggccgttgcttcacaacgttcaaatccgctcccggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42146 - DNA, 337 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtaagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42147 - DNA, 339 bp, Artificial
  Mutation in BnaC.FAD2.b introduced by TALE nuclease pair BnFAD2_T03
caggatccatgggtgcaggtggcagaatgcaagtgtctcctccctccagctcccccggaaccaacaccctcaaacgcgtcccctgcgagacaccaccattcacttcctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42148 - DNA, 336 bp, Artificial
  Mutation in BnaC.FAD2.b introduced by TALE nuclease pair BnFAD2_T03
caggatccatgggtgcaggtggcagaatgcaagtctctactccctcaagctcccccggaaacaacaccctcaaacgcgtcccctgcaagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctccacagggcctcccatggctgctgcctaacgcgcctctgggtcatagcccgcgtgtgcgtcgaccacgcctacagcgactac

SEQ ID NO: 42149 - DNA, 350 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctccccccccctctcccttccctcgcctggcccctctactgggcctgccaaggctgcgtcctaacgggcctctgggtcatcgcccacgaatgcggccaccacgccttcagcgaccac

SEQ ID NO: 42150 - DNA, 314 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42151 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgagtgcggccaccacgccttcagcgactac

SEQ ID NO: 42152 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacacactcaaacgcgtcccctgcgagacaccaccattctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42153 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccatttcggagacctcaagaaagcaatcccacctcactgcttcaaacgccccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42154 - DNA, 342 bp, Artificial
  Mutation in BnaC.FAD2.b introduced by TALE nuclease pair BnFAD2_T03
caggatccatgggtgcaggtggaagaatgcaagtctctcctccatccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctcgcccctctactgggcctgcccagcgtgcgtcctcaccggcgtctgggtcatagcccacgattgcggccaccacgccttcagcgactac

SEQ ID NO: 42155 - DNA, 280 bp, Artificial
  Mutation in BnaC.FAD2.b introduced by TALE nuclease pair BnFAD2_T03
caggatccatgggtgcaggtggaagaatgcaagtctcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgcctgctgcgactac

SEQ ID NO: 42156 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 42157 - DNA, 349 bp, Artificial
  Mutation in BnaC.FAD2.b introduced by TALE nuclease pair BnFAD2_T03
caggatccatgggtgcaggtggaagaatgcaagtttctcctccctccagctcccccgaaaccaaaaccctcaaacgcgtcccctgcgagacaccacccttcactaagacctcaagaaagcaatcccacctcactgcttcaaacgctccatccctcgctccttctcctacctcctcttcgacatcctcgtctcctcctccctctaccacctctccacatcctacttccctctcctcccccaccctctcccttacctcgcctggcccctctactgggcctgccaaggctgcttcctaacgggcctctgggtcatcgcccacgaatgcggccaccacgccttcagcgactac

SEQ ID NO: 42158 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42159 - DNA, 349 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagcgcggccaccacgccttcagcgactac

SEQ ID NO: 42160 - DNA, 342 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactccagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 42161 - DNA, 349 bp, Artificial
  Mutation in BnaC.FAD2.b introduced by TALE nuclease pair BnFAD2_T03
caggatccatgggtgcaggtggcagaatgcaagtgtctactccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctggcccctctactgggcctgccaaggctgcttcctaacgggcctctgggtcatcgcccacgaatgcggccaccacgccttcagcgactac

SEQ ID NO: 42162 - DNA, 337 bp, Artificial
  Mutation in BnaC.FAD2.b introduced by TALE nuclease pair BnFAD2_T03
caggatccatgggtgcaggtggcagaatgcaagtctatcctccctccagctcccccgaaaccaaaaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42163 - DNA, 392 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacgctcaagtcagaggtggcgaaacccgacaggactataaagataccaggcgttagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 42164 - DNA, 335 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42165 - DNA, 342 bp, Artificial
  Mutation in BnaC.FAD2.b introduced by TALE nuclease pair BnFAD2_T03
catgatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 42166 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggagcaggtggtggccatcgccagcaatattggtggcaagcaggcgctggagacggtgcgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 42167 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggtctgccaaggctgcgtcctaacgggcctctgggtcatagcccacgagtgcggccaccacgccttcagcgactac

SEQ ID NO: 42168 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgtcaaggctgcgtcctaacgggcctctgggtcatcgcccacgaatgcggccaccacgccttcagcgactac

SEQ ID NO: 42169 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42170 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42171 - DNA, 342 bp, Artificial
  Mutation in BnaC.FAD2.b introduced by TALE nuclease pair BnFAD2_T03
caggatccatgggtgcaggtggaagaatgcaagtctctaatccctccagctcccccgaaaccaaaaccctcaaacgcgtcccctgcgagacaccacccttcactccagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggcctccacgccttcagcgactac

SEQ ID NO: 42172 - DNA, 331 bp, Artificial
  Mutation in BnaC.FAD2.b introduced by TALE nuclease pair BnFAD2_T03
caatccatgggtgcaggtggaagaatgctagtctctcctccctccagctcccccgaaaccaaaaccctcaaacgcgtcccctgcgagacaccacccttcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42173 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42174 - DNA, 431 bp, Artificial
  Mutation in BnaC.FAD2.b introduced by TALE nuclease pair BnFAD2_T03
caggatccatgggtgcaggtcgaagaatgcaagtctatcctccctccagctcccccggaaccaacaccctcaaacgcgtcccctgcgagacaccaccattcactctgcgagacaccaccatgcaagtctctcctccctccagctcccccggaaccaacaccctcaaccgcgtcccctgcgagacaccaccacctaagaaagcaatcccacctcactgcttcaaacgctccatccctctctccttctcctacctcctcttcgacatcctcgtctcctcctccctctaccccctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42175 - DNA, 335 bp, Artificial
  Mutation in BnaC.FAD2.b introduced by TALE nuclease pair BnFAD2_T03
caggatccatgggtgcaggtggcagaatgcaagtctctcctccctcccgctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagggcggccaccacgccttcagcgactac

SEQ ID NO: 42176 - DNA, 333 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaactcaagaaagcaatcccaccgcactgtttcaaacgctcgatccctccccctttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42177 - DNA, 278 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacatcctcgagtccgcctccctctaccacctctccacagcctccttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 42178 - DNA, 335 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtagaactcaagaaagcaatcccaccgcactgtttcaaacgctcgatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42179 - DNA, 386 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctggcaacgctgcgatcatgtcctgatacttgacagcgacggtccctttcgcagacctcaagaaagcaatcccacctcactgcttcaaacgctccatccctcgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42180 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccatcagcgactac

SEQ ID NO: 42181 - DNA, 411 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagttgccggtgctgtgccaggcccacggcttgaccccccagcaggtggtggccatccccagcagacctcaagaaagcaatcccacctcactgcttcaaacgctccatcccacgctccttctcctcttcgacatcatcatctcctcctcggctcctccctctaccccctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42182 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgccctaacgggcctctgggtcatcgcccacgaatgcgaccaccacgccttcagcgactac

SEQ ID NO: 42183 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacatgagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 42184 - DNA, 293 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42185 - DNA, 372 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgccggtgctgtgccaggcccagacctcaagaaagcaatcccacctcactgcttcaaacgctccatccctcgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42186 - DNA, 349 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgtgtcctaacgggcctctgggtcctcgcccacgaatgcggccaccacgccttcagcgactac

SEQ ID NO: 42187 - DNA, 257 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 42188 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaccctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgcctgcagcgactac

SEQ ID NO: 42189 - DNA, 344 bp, Artificial
  Mutation in BnaC.FAD2.b introduced by TALE nuclease pair BnFAD2_T03
caggatccatgggtgcatgtggaagaatgcaagtgtctcctccctccaagaagtctgaaaccgacaccatcaaacgcgtcccctgcgagacaccacccttcactctcaataaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42190 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctccccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42191 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagggcggccaccacgccttcagcgactac

SEQ ID NO: 42192 - DNA, 286 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacatcatcatctcctcctcggctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 42193 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 42194 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42195 - DNA, 405 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactctcggctgttgccggtgctgtgccaggcccacggcttgaccccggagcaggtggtggccatcggagacctcaagaaagcaatcccacctcactgcttcaaacgctccatcccacgctccttctcctcttcgacatcctcgtctcctcctccctctaccccctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42196 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttcctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaagggtgcgtcctaaccggcgtctgggtcatagcccacgagtgcggccaccacgccttcagcgactac

SEQ ID NO: 42197 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgccctaacgggcctctgggtcatagcccacgagtgcggccaccacgccttcagcgactac

SEQ ID NO: 42198 - DNA, 350 bp, Artificial
  Mutation in BnaC.FAD2.b introduced by TALE nuclease pair BnFAD2_T03
caggatccatgggtgcaggtggaagaatgcaagagtctcctccctccaagaagtctgaaaccgacaccatcaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccccaaatgcggccaccacgccatcagcgactac

SEQ ID NO: 42199 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgagtgcggccaccacgccttcagcgactac

SEQ ID NO: 42200 - DNA, 335 bp, Artificial
  Mutation in BnaC.FAD2.b introduced by TALE nuclease pair BnFAD2_T03
catgatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42201 - DNA, 330 bp, Artificial
  Mutation in BnaC.FAD2.b introduced by TALE nuclease pair BnFAD2_T03
caggatccatgggtgcaggtggcagaatgcaagtctctcctccctccagctcccccggaaccaaaaccctcaaacgcgtcccctgtagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 42202 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaccctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgcctgcagcgactac

SEQ ID NO: 42203 - DNA, 331 bp, Artificial
  Mutation in BnaC.FAD2.b introduced by TALE nuclease pair BnFAD2_T03
caggatccatgggtgcaggtggaagaatgcaagtggctcctccctccaagaagtctgaaaccgacaccatcaagcgcgtaccctgcgagacaccgcccttcactgactcaagaaagcaatccaacctcactgcttcaaacgctccatccctcgctccttctcctacctcctcttcgacatcctcgtctcctcctccctctaccacctctccacagcctacttccctctcccttacctcgcctgacccctctcctgggcctgccaaggctgcgtcctaacgggcctctgggtcatagcccacgagtgcggccaccacgccatcagcgactac

SEQ ID NO: 42204 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 42205 - DNA, 345 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42206 - DNA, 352 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtccactgcgagacaccacccttcactccttagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42207 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccaccccactgcttcaaacgctccatccctcgctccttctcctacctcctcttcgacatcctcgtctcctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 42208 - DNA, 295 bp, Artificial
  Mutation in BnaC.FAD2.b introduced by TALE nuclease pair BnFAD2_T03
caggatccatgggtgcaggtggaagaatgcaagtctctcatccctccaggtagacctcaagaaagcaatcccaccgcaatgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 42209 - DNA, 332 bp, Artificial
  Mutation in BnaC.FAD2.b introduced by TALE nuclease pair BnFAD2_T03
caggatccatgggtgcaggtggaagaatgcaagtctctcccctccagctcccccgaaaccaaaaccctcaaacgcgtcccctgcgagacaccacccttcacttagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgtgtcctaacgggcctctgggtcatagcccacgagtgcggccaccacgccttcagcgactac

SEQ ID NO: 42210 - DNA, 382 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactctctgagcctttcgttttatctgttgtttgtcggtgaacgctctcctgagacctcaagaaagcaatcccacctcactgcttcaaacgctccatcccacgctccttctcctcttcgacatcatcatctcctcctcggctcctccctcttccacctccccacagcctacttccctctcccttacctcgcctgacccctctactgggcctgccaaggctgcgtcctaacgcgcctctgggtcatagcccacgagtgcggccaccacgccttcagcgactac

SEQ ID NO: 42211 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggcaaccacgcctgcagcgactac

SEQ ID NO: 42212 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctagcaggcgctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 42213 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 42214 - DNA, 397 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattccggatggcctttttgcgtttctacaaactcttcctggctagcggtacgcgtattaattgcgttgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42215 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccacctcactgcttcaaacgctccatcccacgctccttctcctcttcaacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42216 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatcgcccacgaatgcggccaccacgccttcagcgactac

SEQ ID NO: 42217 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 42218 - DNA, 386 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggtggtggccatcgccagcaatattggtggcaagcaggcgctgagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42219 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaccgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccatcagcgactac

SEQ ID NO: 42220 - DNA, 340 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactctcgggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42221 - DNA, 336 bp, Artificial
  Mutation in BnaC.FAD2.b introduced by TALE nuclease pair BnFAD2_T03
caggatccatgggtgcaggttgaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42222 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42223 - DNA, 389 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagtcctgtcgggtttcgccacctctgacttgagcgtcgatttttgtgatgctcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42224 - DNA, 304 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42225 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgccagacctcaagaaagcaatcccacctcactgcttcaaacgctccatccctcgctccttctcctacctcctcttcgacatcctcgtctcctcctccctctaccacctctccacagcctacttccctctcccttacctcgcatgacccctctactgggcctgccaaggctgcgtcctaacgggcctctgggtcatagcccacgagtgcggccaccacgccttcagcgactac

SEQ ID NO: 42226 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42227 - DNA, 328 bp, Artificial
  Mutation in BnaC.FAD2.b introduced by TALE nuclease pair BnFAD2_T03
caggatcatgggtgcaggtggaagaatgcaagtctctcctccctccagctcccccggaaccaacaccctcaaactcctccctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctggtcatcgcccacgaatgcggccaccacgccttcagctactac

SEQ ID NO: 42228 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 42229 - DNA, 279 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42230 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcttcaaacgctccatcccacgctccttctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 42231 - DNA, 350 bp, Artificial
  Mutation in BnaC.FAD2.b introduced by TALE nuclease pair BnFAD2_T03
caggatccatgggtgtaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaactggcctctgggtcatcgcccacgaatgcggccaccacgccttcagcgactac

SEQ ID NO: 42232 - DNA, 376 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggtggccatcgccagcaatggcggtggcaacagccgctggagacctcaagaaagcaatcccacctcactgcttcaaacgctccatccctcgctccttctcctcgtcgacatcatcatctcctcctcggctcctccctctaccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 42233 - DNA, 334 bp, Artificial
  Mutation in BnaC.FAD2.b introduced by TALE nuclease pair BnFAD2_T03
caggatccatgggtgcaggtgggagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42234 - DNA, 369 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgaggcccacggcttgaccccggagcaggtggtggccatcgcctggcacgatggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccgtcagcgactac

SEQ ID NO: 42235 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacctcctacttccctctcctcccccaccctctcccttccctctcctcccccctctcctgggcctgccaaggctgcgtcctaacgggcctctgggtcatcgcccacgaatgcggccaccacgccttcagcgactac

SEQ ID NO: 42236 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaactggcctctgggtcatcgcccacgaattcggccaccacgccttcagcgactac

SEQ ID NO: 42237 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcttggtcatcgcccacgaatgcggccaccacgccttcagcgactac

SEQ ID NO: 42238 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 42239 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgggaactcaagaaagcaatcccacctcactgcttcaaacgctccatccctcgctccttctcctacctcctcttcgacatcctcgtctcctcatccctctaccacctctccacagcctacttccctctcctcccacaccctctcccttacctcgcctggcccctctactgggcctgccaaggctgcgtcctaaccggcgtctgggtcatagcccacgagtgcggccaccacgccttcagcgactac

SEQ ID NO: 42240 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42241 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacttggcctgccaaggctgcgtcctaacgggcctctgggtcatagcccacgagtgcggccaccacgccttcagcgactac

SEQ ID NO: 42242 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagggcggccaccacgccttcagcgactac

SEQ ID NO: 42243 - DNA, 336 bp, Artificial
  Mutation in BnaC.FAD2.b introduced by TALE nuclease pair BnFAD2_T03
caggatccatgggtgcaggtggaagaatgcaagtgtctcctccctcccgctagcccggaaccaacaccctcaaacgcgtcccctgcgagacaccaccattcactctagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatcgcccacgagtgcggccaccacgccttcagcgactac

SEQ ID NO: 42244 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 42245 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatagcctttctagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42246 - DNA, 350 bp, Artificial
  Mutation in BnaC.FAD2.b introduced by TALE nuclease pair BnFAD2_T03
catgatccatgggtgcaggtggaagaatgcaagtgtctcctccctccaagaagtctgaaaccgacaccatcaagcgcgtaccctgcgagacaccacccttcactctcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctcacgggcctctgggtcatagcccacgagggcggccaccacgccttcagcgactac

SEQ ID NO: 42247 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccatggctgcgtcctaacgggcctctgggtcatagcccacgagtgcggccaccacgccggcagcgactac

SEQ ID NO: 42248 - DNA, 322 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 42249 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgccatcctcgtctcctcctccctctaccacctctccacagcctacttccctctcctcccccaccctctcccttacctcgcctggcccctctactgggcctgccaaggctgcgccctaacgggcctctgggtcatagcccacgagtgcggccaccacgccttcagcgactac

SEQ ID NO: 42250 - DNA, 370 bp, Artificial
  Mutation in BnaC.FAD2.b introduced by TALE nuclease pair BnFAD2_T03
caggatccattggtgcaggtggaagaatgcaagtgtctcctccctccaaaaagtctgaaaccgacaacatcaaacgcgtcccctgcgagacaccacccttccccggagcaggtggtggccatcgccagcaatattggtggagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42251 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 42252 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaataaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42253 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacatcaagaaagcaatcccacctcactgcttcaaacgctccatccctcgctccttctcctacctcctcttcgacatcctcgtctccttctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42254 - DNA, 355 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacggtggtttgtttgccggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42255 - DNA, 350 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctatttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42256 - DNA, 295 bp, Artificial
  Mutation in BnaC.FAD2.b introduced by TALE nuclease pair BnFAD2_T03
caggatccatgggtgcaggcggaagaatgcaagtctctcctccctccagctcccccgaaaccaaaaccctccacctcactgcttcaaacgctacatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42257 - DNA, 265 bp, Artificial
  Mutation in BnaC.FAD2.b introduced by TALE nuclease pair BnFAD2_T03
caggatccatgggtgcaggtggaagaatgcaagtctctcctccctccagtctctccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 42258 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgcctgcagcgactac

SEQ ID NO: 42259 - DNA, 400 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggagacggtccagcggctgttgccggtgctgtgccaggcccacggtccagcggctgttgccggagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 42260 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatcgcccacgaatgcggccaccacgccttcagcgactac

SEQ ID NO: 42261 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 42262 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctcttcgccatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42263 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatagacctcaagaaagcaatcccacctcactgcttcaaacgctccatcccacgctccttctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 42264 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 42265 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacctcaagaaagcaatcccaccgcactgtttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 42266 - DNA, 430 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcctcaagaacaaaatcccaccgcactgtttcaaatgcaagcgcccactctccttctcctcttccacctcctcatctcctcctcggctcccccatccaccccctctcctcaccctacttcactctcctcccccccctccccccctcgccaccaccacctcctcctcgcctcctccatctaccacctctccacagcctacttccctctcctcccccaccctctcccctacttcgcctggcctctctactgggcctgccaagggtgcgtcctaaccggcgtctgggtcatagcccacgagtgcggccaccacgccttcagcgactac

SEQ ID NO: 42267 - DNA, 327 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttccctcaagaaagcaatcccaccgcactgtttcaaacgctccatccctcgctccttctcctacctcctcttcgacatcctcgtctcctcctccctctaccacctctccacagcctcctcccctctcccttacctcgcctgacccctctactgggcctgccaaggctgcgtcctaacgggcctctgggtcatagcccacgagtgcggccaccacgccttcagcgactac

SEQ ID NO: 42268 - DNA, 341 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccacccttcactctgaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42269 - DNA, 335 bp, Artificial
  Mutation in BnaC.FAD2.b introduced by TALE nuclease pair BnFAD2_T03
caggtccatgggtgcaggttgaagaatgcaagtgtctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttccctcgcctgacccctctactgggcctgccaaggctgcgtcctaacgggcctctgggtcatagcccacgagtgcggccaccacgccagcagcgactac

SEQ ID NO: 42270 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagcctacttccctctcctcccccaccctctcccttgcctcgcctggcccctctcctgggcctgccaaggctgcgtcctaacgggcctctgggtcatcgcccacgaatgcggtcaccacgccttcagcgactac

SEQ ID NO: 42271 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 42272 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatcggagacctcaagaaagcaatcccacctcactgcttcaaacgctccatcccacgctccttctcctcttcgacatcatcatctcctcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42273 - DNA, 334 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42274 - DNA, 335 bp, Artificial
  Mutation in BnaC.FAD2.b introduced by TALE nuclease pair BnFAD2_T03
caggatccatggggcaggtggaagaatgcaagtctctcctccctccagctcccccggaaccaacaccctcaaacgcgtcccctgcgagacaccaccattcactctcaacctcaagaaagcaatccaacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42275 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgagtgcggccaccacgccttcagcgactac

SEQ ID NO: 42276 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 42277 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacatcacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42278 - DNA, 438 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgtgccacgctgagagccagcagccaatgaaaaatctaagggggtcaagccgtgggcctggcacagcaccggcaagcaggcgctggagaagaactcaagaaagcaatcccacctcactgcttcaaactctccatccctcgctccttcccctccctccccttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42279 - DNA, 329 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcggcctaacgggcctctgggtcatagcccacgagtgcggccaccacgccttcagcgactac

SEQ ID NO: 42280 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcatcgtctcctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 42281 - DNA, 335 bp, Artificial
  Mutation in BnaC.FAD2.b introduced by TALE nuclease pair BnFAD2_T03
caggatccatgggtgcaggtggaagaatgcaagtctctcctccctcaagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactggacctgccaaggctgcgtcctaacgggcctctgggtcatagcccacgagtgcggccaccactccatcagcgactac

SEQ ID NO: 42282 - DNA, 333 bp, Artificial
  Mutation in BnaC.FAD2.b introduced by TALE nuclease pair BnFAD2_T03
caggatccatgggtgcaggtgcaagaatgcaagtctctcctccctccagctcccccggacccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 42283 - DNA, 373 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgcgttatcccctgattctgtggataaccgtattaccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42284 - DNA, 338 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42285 - DNA, 350 bp, Artificial
  Mutation in BnaC.FAD2.b introduced by TALE nuclease pair BnFAD2_T03
caggatccatgggtgcaggtggaagaatgcaagtctctcctccctccagcttccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42286 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42287 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcacttagacctcaagaaagcaatcccacctcactgcttcaaacgctccatccctcgctacttctcctacctcctcttcgacatcctcgtctcctcctccctctaccacctatccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42288 - DNA, 324 bp, Artificial
  Mutation in BnaC.FAD2.b introduced by TALE nuclease pair BnFAD2_T03
caggatccatgggtgcaggtgcaagaatgcaagtctctcctccctccagctcccccgaaaccaaaaccctcaaacgcgtcccctgcgagacctcaagaaagcaatcccacctcactgcttcaaacgctccatccctcgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccagcagcgactac

SEQ ID NO: 42289 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaacgggcctctgggtcatagcccacgagtgcggccaccacgccttcagcgactac

SEQ ID NO: 42290 - DNA, 410 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattgagcggatttgtcctactcaggagagcgttcaccgacaaacaacagataaaacgaaaggcccagtcttccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42291 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcgacctcaagaaagcaatcccacctcactgcttcaaacgctccatcccacgctccttctcctcttcgccatcatcatctcctcctcgcctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 42292 - DNA, 337 bp, Artificial
  Mutation in BnaC.FAD2.b introduced by TALE nuclease pair BnFAD2_T03
caggatccatgggtgcaggtggaagattgcaagtctctcctccctccagctcccccggaaccaacaccctcaaacgcgtcccctgcgagacaccaccattcactctaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42293 - DNA, 386 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcggcctttttacggttcctggccttttgctggccttttgctcacatgttctttcctgcgttatcccccgggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42294 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcaccacttcaaacgctccatcccccgctccttctcctacctccccttcgccatccccgtctccccctccctctaccacctctccacatcctacttccctctcctccccccccctctcccttacctcgcctggcccctctactgggcctgccaaggctgcgtcctaacgggcctctgggtaatcgcccacgaatgcggccaccacgtcttcagcgactac

SEQ ID NO: 42295 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42296 - DNA, 409 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggctgcggcgagcggtatcagctcactcaaaggcggtaatacggttatccacagaatcagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctaccagggctgcgtcctaaccggcgtctgggtcatagcccacgagtgcggccaccacgccttcagcgactac

SEQ ID NO: 42297 - DNA, 345 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42298 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccatgacagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 42299 - DNA, 301 bp, Artificial
  Mutation in BnaC.FAD2.b introduced by TALE nuclease pair BnFAD2_T03
caggatccatgggtgcaggtggaagaatgcaagtgtctcctccctcccgtccccccggaaacaacaccctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 42300 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgccatcatcatctcctcctcggctcctccctctaccacctctccacagcctacttccctctcctcccccaccctctcccttacctcgcctggcccctctactgggccggccaaggctgcgtcctaacgggcctctgggtcatagcccacgagtgcggccaccacgccttcagcgactac

SEQ ID NO: 42301 - DNA, 325 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 42302 - DNA, 350 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 42303 - DNA, 279 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggccatcgcccacgaatgcggccaccacgccttcagcgactac

SEQ ID NO: 42304 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactaaagcaatcctccctcacttcatcaaacgctccattcctcgctccttctcctatctccccttcgacatcctcatcttctcctccctctaccactcctccacatcctacttccctcacctcccccaccctctcccttacctcgcctggcccctctactgggcctgccaaggctgcctcctaaccggcctctggttcatcgcccacgaatgcggccaccacgccttcagcgactac

SEQ ID NO: 42305 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccgtcagcgactac

SEQ ID NO: 42306 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 42307 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgattcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42308 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42309 - DNA, 349 bp, Artificial
  Mutation in BnaC.FAD2.b introduced by TALE nuclease pair BnFAD2_T03
caggatccatgggtgcaggtgcaagaatgcaagtctctactccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatcgcccacgaatgcggccaccacgcctgcagcgactac

SEQ ID NO: 42310 - DNA, 450 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagcttgacggggaaagccggcgaacgtggcgagaaaggaagggaagaaagcgaaaggagcgggcgctaggtttagggttgcgatttagtgctttacggcacctcgaccccaaaagacctcaagaaagcaatcccacctcactgcttcaaccgccccatcccgcgctccttctcctctccgacatcatcacctcctcctcggctccgccctctcccacctcgccacggcctacttccctctcccttccctcgcctgacccctctactgggcctgccaaggctgcgtcctaacgggcctctgggtcatagcccacgagtgcggccaccacgccttcagcgactac

SEQ ID NO: 42311 - DNA, 333 bp, Artificial
  Mutation in BnaC.FAD2.b introduced by TALE nuclease pair BnFAD2_T03
caggatccatgggtgcaggtggaagaatgcaagtctctcctgcctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42312 - DNA, 345 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccacccttgagacctcaagaaagcaatcccacctcactgcttcaaacgctccatccctcgctccttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgcctgcagcgactac

SEQ ID NO: 42313 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagcaagcaatcccacctcactgcttcaaacgctccatcccaccctccttctcctcttccacatcatcatctcctcctcgcctcctccctctaccacctctccacagcctccttccctctcccttacctcgcctaacccctctcctgggcctgccaaggctgcgtcctaacgggcctctgggtcatcccccacgaatgcggccaccacgccttcagcgactac

SEQ ID NO: 42314 - DNA, 346 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42315 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42316 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaacactcaaacgcgtcccctgcgagacaccacccttcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42317 - DNA, 330 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42318 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacagacctcaagaaagcaatcccacctcactgcttcaaacgctccatccctcgctccttctcctacctcctcttcgacatcctcgtctcctcctccctctaccacctctccacaacctacttccctctcctcccccaccctctcccttacctcgcctggcccctctactgtgcctgccaagggtgcgtcctaacgggcctctgggtcatagcccacgagtgcggccaccacgccttcagcgactac

SEQ ID NO: 42319 - DNA, 339 bp, Artificial
  Mutation in BnaC.FAD2.b introduced by TALE nuclease pair BnFAD2_T03
caggatccatgggtgcaggtggaagaatgcaagtctctcctccctacagctcccccgaacccaaaacccccaaccgcgtcccctgccggacaccaaaacctcaaaaaagcaatcccaccccactgcttcaaacgctccatccctcgctccttctcctacctcctctccgacatcctcgtctcctcctccctctaccacctctccacagcctacttccctctcctcccccaccctctcccttacctcgcctggcccctctactgggcctgccaaggctgcgtcctaacgggcctctgggtcatcgcccaccaaggcggccaccacgcctgcagcgactac

SEQ ID NO: 42320 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42321 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42322 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42323 - DNA, 334 bp, Artificial
  Mutation in BnaC.FAD2.b introduced by TALE nuclease pair BnFAD2_T03
caggatccatgggtcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42324 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtcctaacgggcctctgggtcatcgcccacgaatgcggccaccacgccttcagcgactac

SEQ ID NO: 42325 - DNA, 292 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 42326 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42327 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42328 - DNA, 376 bp, Artificial
  Mutation in BnaC.FAD2.b introduced by TALE nuclease pair BnFAD2_T03
caggatacatgggtgcagggggaagaatgcaagtctctcctccctccagctcccccgaaaccaaaaccctcaaacgcgtcccctgcgagacaccaccgttcactatgctgcgtaacatcgtagcggctccagagacctcaagaaagcaatcccacctcactgcttcaaacgctccatccctcgctcgttctcctacctcatcttcgacatcctcgtctcctcctccctctaccacctctccacagcctacttccccctcctccccccccctctccctcccctcgccggtcccctctactcggcctgccaagcctgcgtcctaacgggcgtctgggtcatagccctcgagtgcggccaccacgccttcagcgactac

SEQ ID NO: 42329 - DNA, 331 bp, Artificial
  Mutation in BnaC.FAD2.b introduced by TALE nuclease pair BnFAD2_T03
caggatccatgtgtgcaggtggaagaatgcaagtctctcctccctccagctcccccgaaaccaaaaccctcaaacgcgtcccctgcgagacaccacccttcactctcggcttcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 42330 - DNA, 337 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactcggagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42331 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaagcgcgtcccctgcgagacaccaccattcactagccctcaagacagcaatcccacctcactgcttcaatcgctccaccccaccccccttctcctctccgacatcatcatctcctcctcggctcctccctctaccacctctccacagcccacttccctctcccttacctcgcctggcccctctactgggcctgccaaggctgcgtcctaacgggcctctgggtcatagcccacgagtgcggccaccacgccttcagcgactac

SEQ ID NO: 42332 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccgtcagcgactac

SEQ ID NO: 42333 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 42334 - DNA, 395 bp, Artificial
  Mutation in BnaC.FAD2.b introduced by TALE nuclease pair BnFAD2_T03
caggatccatgggtgcaggtggaagaatgcaagtctctcctccatcccgctcccccggaaccaacaccctcaaacgcgtcccctgcgagacaccacccttcactctcaggggaagccgaagtttccaaaaggtcgttgatcaaagctcgccgcgttgtttcatcggagacctcaagaaagcaattccacctcactgcttcaaacgctccatccctcgctccttctcctacctcctcttcgacatcctcgtctcctcctccctctaccgcctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42335 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactctcggcctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42336 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 42337 - DNA, 314 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctcctacttcgcctggcctctctactgggcctgccaagggtgcgtcctaaccggcgtctgggtcatagcccacgagtgcggccaccacgccttcagcgactac

SEQ ID NO: 42338 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 42339 - DNA, 337 bp, Artificial
  Mutation in BnaC.FAD2.b introduced by TALE nuclease pair BnFAD2_T03
caggatccatgggtgcaggtggaagaatgtaagtctctcctccctccagctcccccggaaccaacaccctcaaacgcgtcccctgcgagacaccaccattcactctgagacctcaagaaagcaatcccacctcactgcttcaaacgctccatcccacgctccttctcctctccgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42340 - DNA, 335 bp, Artificial
  Mutation in BnaC.FAD2.b introduced by TALE nuclease pair BnFAD2_T03
cagggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcattcagcgactac

SEQ ID NO: 42341 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgactgcagcgactac

SEQ ID NO: 42342 - DNA, 351 bp, Artificial
  Mutation in BnaC.FAD2.b introduced by TALE nuclease pair BnFAD2_T03
catgatccatgggtgcaggtggaagaatgcaagtgtctcctccctccaagaagtctgaaaccgacaccatcaagcgcgtaccctgcgagacaccgcccttcactgggagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42343 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaacaaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42344 - DNA, 342 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccctcaaacgcgtcccctgcgagacaccacccttccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctcccccctctcctgggcctgccaaggctgcgtcctaacgggcctctgggtcatcgcccacgaatgcggccaccacgccttcagcgactac

SEQ ID NO: 42345 - DNA, 351 bp, Artificial
  Mutation in BnaC.FAD2.b introduced by TALE nuclease pair BnFAD2_T03
caggatccatgggtgcaggtggaagaatgcaagtctctcctccctcccgctcccccggaaccaacaccctcaaacgcgtcccctgcgagacaccacccttcactctgagacctcaagaaagcaatcccacctcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42346 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttagacctcaagaaagcaatcccacctcactgcttcaaacgctccatcccacgctccttctcctcttcgacatcatcatctcctcctcggctcctccctctaccacctctccacagcctacttccctctcccttacctcgcctgaccccgctactgggcctgccaaggctgcgtcctaacgggcctctgggtcatagcccacgagtgcggccaccacgccttcagcgactac

SEQ ID NO: 42347 - DNA, 351 bp, Artificial
  Mutation in BnaC.FAD2.b introduced by TALE nuclease pair BnFAD2_T03
caggatccatgggtgcaggtggaagaatgcaagtatctcctccctcaagctcccccggaaccaacaccctcaaacgcgtcccctgcgagacaccaccattcactctcgacctcaagaaagcaatcccacctcactgcttcaaacgctccatcccacgctccttctcctcttcgacatcatcatctcctcctcggctcctccctctaccacctctccacagcctacttccctctcctcccccaccctctccctcacctcgcctggcccctctactgggcctgccaaggctgcgtcctaacgggcctctgggtcatcgcccacgaatgcggccaccacgccgtcagcgactac

SEQ ID NO: 42348 - DNA, 433 bp, Artificial
  Mutation in BnaC.FAD2.b introduced by TALE nuclease pair BnFAD2_T03
caggatcctgggtgcaggtggaagaatgcaagtctctcctccctccagctcccccgaaaccaaaaccctcaaacgcgtcccctgcgagacaccacccttcactctcggaccgtctccagcgcctgcttgccaccgccattgctggcgatggccaccacctgctggggggtcaagccgtgggcctggcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42349 - DNA, 332 bp, Artificial
  Mutation in BnaC.FAD2.b introduced by TALE nuclease pair BnFAD2_T03
aggatcaatgggtgcaggtggaagaatgcaagtctctcctccctccagctcccccgaaaccaaaaccctcaaacgcgtcccctgcgagacaccacccttcactgacctcaagaaagcaatcccacctcactgcttcaaacgctccatcccacgctccttctcctcttcggcatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42350 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaagggtgcgtcctaaccggcgtctgggtcatagcccacgagtgcggccaccacgccttcagcgactac

SEQ ID NO: 42351 - DNA, 459 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcttgccctgacgagaaacaccagaacgggtagtgaattgcgcttgagatggtttaatttcaactttaatcattgtgaattaccttatgcgattttaagaactggcgagaactcaagaaagcaatcccacctcactgcttcaaacgctccatccctcgctccttctcctacctccccttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 42352 - DNA, 315 bp, Artificial
  Mutation in BnaC.FAD2.b introduced by TALE nuclease pair BnFAD2_T03
caggatccatgggtgcaggtggaagaatgcgagtctctcctccctcccgtccccccggaaacaacaccctcagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 42353 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42354 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctacctcaagaaagcaatcccacctcactgcttcaaacgctccatccctcgctccttctcctacctcctcttcgacatcctcgcctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42355 - DNA, 357 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggtccctctactgggcctgccaaggctgcgtcctaacgggcctctgggtcatcgcccacgaatgcggccaccacgccttcagcgactac

SEQ ID NO: 42356 - DNA, 344 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacactcaagaaagcaatcccaccgcactgtttcaaacgctccatccctcgctccttctcctacctcctcttcgacatcctcgtctcctcctccctctaccacctatccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42357 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctaaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 42358 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactc

SEQ ID NO: 42359 - DNA, 328 bp, Artificial
  Mutation in BnaC.FAD2.b introduced by TALE nuclease pair BnFAD2_T03
catgatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42360 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcctcgtctcctcctcggctcctccctctaccacctctccacagcctacttccctctcccttacctcgcctgacccctctactgggcctgccaaggctgcgtcctaacgtgcctctgggtcatagcccacgagtgcggccaccacgccatcagcgactac

SEQ ID NO: 42361 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42362 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42363 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaagcgctccatccctcgctccttctcctacctcctcttcgccatcctcgtctcctccgccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42364 - DNA, 356 bp, Artificial
  Mutation in BnaC.FAD2.b introduced by TALE nuclease pair BnFAD2_T03
caggatccatgggtgcaggcggaagaatgcaagtctctcctccctccaagaagtctgaaaccgacaccatcaagcgcgtaccctgcgagacaccgcccttcacttcttccaccgtactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctggttcatcgcccacgaatgcggccaccacgccagcagcgactac

SEQ ID NO: 42365 - DNA, 336 bp, Artificial
  Mutation in BnaC.FAD2.b introduced by TALE nuclease pair BnFAD2_T03
caggatacatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42366 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgtcaaggctgcgtcctaacgggcctctgggtcatcgcccacgaatgcggccaccacgccttcagcgactac

SEQ ID NO: 42367 - DNA, 419 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcaacagccgctggaccgtctccagcgcctgcttgccaccattattgctggcgatggccaccacctgccatcccacgttccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42368 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaaacgcgtcccctgttatcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatatcccacgagtgcggccaccacgccttcagcgacttc

SEQ ID NO: 42369 - DNA, 397 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgatacaccaccattcactcagccgaacgaccgagcgcagcgagtcagtgagcgaggaagcggaagagcgcccaatacgcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42370 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgcttcaaacgctccatcccacgctccttctcctcttcgacatcatcatctcctcctcggctcctccctctaccacctctccacagcctacttccctctcccttacctcgcccgacccctctactgggcctgccaaggctgcgtcctaacgggcctctgggtcatagcccacgagtgcggccaccacgccttcagctactac

SEQ ID NO: 42371 - DNA, 273 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgcctgcagcgactac

SEQ ID NO: 42372 - DNA, 414 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactggcacagcaccggcaacagccgctggaccgtcaggatggccttctgcttagtttgatgcctggcagtttatggcgggcaggaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42373 - DNA, 335 bp, Artificial
  Mutation in BnaC.FAD2.b introduced by TALE nuclease pair BnFAD2_T03
caggatccatgggtgcaggtggaagaatgcaagtgtctcctccctccaacaagtctgaaaccgacaccatcaaacgcgtcccctgcgagacaccaccattcactcagacctcacgcaagcaatcccacctcactgcttcatacgctccatcccacgctccttctcctcttcgacatcatcatctcctcctcgcttcctccctctcccacctctccacagcctacttccctctcccttacctcgcctggcccctctactgggcctgccaaggctgcgtcctaacgggcctctgggtcatagcccacgaatgcggccaccacgccttcagcgactac

SEQ ID NO: 42374 - DNA, 349 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42375 - DNA, 308 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcccgccaaggctgcgtcctaacgggcctctgggtcatcgcccacgaatgcggccaccacgccttcagcgactac

SEQ ID NO: 42376 - DNA, 337 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgtgagacaccacccttcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42377 - DNA, 300 bp, Artificial
  Mutation in BnaC.FAD2.b introduced by TALE nuclease pair BnFAD2_T03
caggatccatgggtgcaggtggaagaatgcaagtgtctcatccctccaagaagtctgaaaccgacaccatcaaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42378 - DNA, 312 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctcaccctctctcctacttcgcctggcctctctactgggcctgccagggctgcgtcctaaccggcgtctgggtcatagcccacgagtgcggccaccacgcctgcagcgactac

SEQ ID NO: 42379 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 42380 - DNA, 345 bp, Artificial
  Mutation in BnaC.FAD2.b introduced by TALE nuclease pair BnFAD2_T03
caggatccatgggtgcaggtggaagaatgcgagtctctcctccctccagctcccccgaaaccaaaaccctcaaacgcgtcccctgcgagacaccacccttgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 42381 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgcctaggctgcgtcctaacgggcctctgggtcatagcccacgagtgcggccaccacgccttcagcgactac

SEQ ID NO: 42382 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42383 - DNA, 385 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtggataaccgtattaccgcctttgagtgagctgacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42384 - DNA, 351 bp, Artificial
  Mutation in BnaC.FAD2.b introduced by TALE nuclease pair BnFAD2_T03
caggatccatgggtgcaggtggaagaatgcaagtctctcctcccttcagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccgcgagtgcggccaccacgccttcagcgactac

SEQ ID NO: 42385 - DNA, 349 bp, Artificial
  Mutation in BnaC.FAD2.b introduced by TALE nuclease pair BnFAD2_T03
caggatccatgggtgcaggtggcagaatgcaagtctctccttcctcccgctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccaccgctccacagcctacttccctctcctcccccaccctctcccttacctcgcctggcccctcaactgggcctgccaaggctgcgtcctaactggcttctggatcatcgcccacgaaggcggccgccacgccttcagcgactac

SEQ ID NO: 42386 - DNA, 481 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactctcgctgcgcgtaactggcacagcaccggcaacagccgctggaccgtctccagcgcctgcttgccaccgccattgctggcgatggccaccacctgctggggggtcaagccgtgggcctggcacagcaccggcaacagccgctggaccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42387 - DNA, 368 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccattcactgtacagccgctggaccgtctccagcgcctgtcggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42388 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacactccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42389 - DNA, 394 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttggccaccacctgctccggggtccagctggaggggtacacctctcacccctcgttgggagacctcaagaaagcaatcccacctcactgcttcaaactccccatcccacgctccttctcctcttcgacagcatcatctcctcctcggctcctccctctaccacctctccacagcctacttccctctcccttccctcgcctgacccctctactgggcctgccaaggctgcgtcctaacgggcctctgggtcatagcccacgagtgcggccaccacgccatcagcgactac

SEQ ID NO: 42390 - DNA, 350 bp, Artificial
  Mutation in BnaC.FAD2.b introduced by TALE nuclease pair BnFAD2_T03
caggatccatgggtgcaggtgaaagaatgcaagtgtctactccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcacctctactgggcctgccaaggctgcgtcctaacgggcctctgggtcatctcccacgaatgcggccaccacgccatgagcgactac

SEQ ID NO: 42391 - DNA, 432 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagcgcctgcttgccaccgccattgctggcgatggccaccacctgctggggggtcaagccgtgggcctggcacagcaccggcaccagccgctgacctcaagaaagcaatcccacctcactgcttcaaacgctccatccctcgctccttctcctacctcctcttcgacatcctcgtctcctcctcggctcctccctctcccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42392 - DNA, 414 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggagctggagacggtccagcggctgttgccggtgctgtgccaggcccacggcttgaccccccagcaggcggtggccatagccctcaagaaagcaatcccacctcactgcttcaaacgctccatccctcgctccttctcctcccgcctcctcgacatcctcctcccctcctccccctcccacctccccacagcctacttccctctcccttacctcgcctgacccctctactgggcctgccaaggctgcgtccgaacgggcctctgggtcatcgcccacgaatgcggccaccacgccttcagcgactac

SEQ ID NO: 42393 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42394 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 42395 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42396 - DNA, 354 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccacccttcactctcgggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacaaatgcggccaccacgccttcagcgactac

SEQ ID NO: 42397 - DNA, 342 bp, Artificial
  Mutation in BnaC.FAD2.b introduced by TALE nuclease pair BnFAD2_T03
caggatccatgggtgcagggggaagaatgcaagtctctcctccctccagctcccccggaaccaacaccctcaaacgcgtcccctgcgagacaccaccaagaccttaagaaagcaatcccacctcactgcttcaaacgctcgatccctcgctctttctcctacctcatctgggacatcatcatagcctcctgctgctactacgtcgccaccacttacttcactctcctccctcaccctctcccttacctcgcctggcccctctactgggcctgccaaggctgcgtcctaacgggcctctgggtcatcgcccacgaatgcggccaccacgccttcagcgactac

SEQ ID NO: 42398 - DNA, 351 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcaagacaccgcccttcactgtcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42399 - DNA, 279 bp, Artificial
  Mutation in BnaC.FAD2.b introduced by TALE nuclease pair BnFAD2_T03
caggatccatgggtgcaggtggaagaatgcaagtctctcctccctcccgctcccccgaaaccaaaaccctcaaacgcgtcccctgcgagacaccacccttcactcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42400 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtatcccaccgcactgtttaaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42401 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaactcaagaaagcaatcccaccgcactgtttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 42402 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctccctccttctcctacctcctcttcgacatcatcatctcctcctcggctcctccctctaccacctctccacagcctccttccctctcccttacctcgcctgacccctctactgggcctgccaaggctgcgtcctaacgggcctctgggtcatagcccacgagtgcggccaccacgccatcagcgactac

SEQ ID NO: 42403 - DNA, 278 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacatcctcgtctcctcctccctctaccacctctccacagcctacttccctctcctcccccaccctctcccttacctcgcctggcccctctactgggcctgccaaggctgcgtcctaacgggcttctgggtcatagcccacgagtgcggccaccacgccttcagcgactac

SEQ ID NO: 42404 - DNA, 396 bp, Artificial
  Mutation in BnaC.FAD2.b introduced by TALE nuclease pair BnFAD2_T03
caggatccatgggtgcaggtggaagaatgcaagtctctactccctcccgctcccccggaaccaacaccctcaaacgcgtcccctgcgagacaccaccattgagcggatttgtcctactcaggagagcgttcaccgacaaacaacagataaaacgaaaggcccagtcttccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcagagcccacgagtgcggccaccacgccttcatcgactac

SEQ ID NO: 42405 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42406 - DNA, 327 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42407 - DNA, 335 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccgtcagcgactac

SEQ ID NO: 42408 - DNA, 384 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacggtccagcggctgttgccggtgctgtgccaggcccacggcttgaccccggagcaggtggtggccagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42409 - DNA, 347 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42410 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcccacctcactgcttcaaacgctccatccctcgctccttctcctacctcctcttcgacatcctcgtctcctcctccctctaccacctctccacagcctacttccctcacctcccccaccctctcccttacctcgcctggcccctctactgggcctgccaaggctgcgtcctaacgggcctctgggtcatcgcccacgaatgcggccaccacgccttcagcgactac

SEQ ID NO: 42411 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgcctgcagcgactac

SEQ ID NO: 42412 - DNA, 384 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttccccggagcaggtggtggccatcgccagcaatattggtggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 42413 - DNA, 293 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42414 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctctgggtcatagcccacgaatgcggccaccacgccttcagcgactac

SEQ ID NO: 42415 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcttctgggtcatagcccacgagtgcggccaccacgccttcagcgactac

SEQ ID NO: 42416 - DNA, 312 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccccgcgagacaccaccattcactagacctcaagaaagcaatcccacctcactgcttcaaacgctccatcccacgctccttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcagcgactac

SEQ ID NO: 42417 - DNA, 389 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttggcggcggcaggccggcgctggagagcattgttgcccagttatctcgccctgatccctcaagaaagcaatcccacctcactgcttcaaacgctccatcccacgctccttctcctcttcgacatcatcatctcctcctcggctcctccctctaccacctccccacagcctacttccctctcccttacctcgcctgacccctctactgggcctgccaaggctgcgtcctaaccggcgtctgggtcatagcccacgagtgcggccaccacgccttcagcgactac

SEQ ID NO: 42418 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccagcagcgactac

SEQ ID NO: 42419 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccaagggtgcgtcctaaccggcgtctgtgtcatagcccacgagtgcggccaccacgccttcagcgactac

SEQ ID NO: 42420 - DNA, 322 bp, Artificial
  Mutation in BnaC.FAD2.b introduced by TALE nuclease pair BnFAD2_T03
caggatccatgggtgcaggtggcagaatgcaagtgtctactccctccaagaagtctgaaaccgacaccatcaagcgcgtaccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 42421 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtccactgcgagacaccacccttcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42422 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42423 - DNA, 349 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaccgcgtcccctgcgagccaccacccttcactcagacctcaagaaagcaatcccacctcactgcttcaaacgcaccatccctcgatccttctcctacctcctcttcgacatcctcgtctcctccaccttctaccacctctccacagcctacttccctctcttcacccaccccctcacatacatcccctggcccctctactgggcctgccaaggctgcgtcctaaccggcgtctgggtcacagcccacaagtgcggtcaccacgcctgcagcgactac

SEQ ID NO: 42424 - DNA, 411 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggagcaggtggtggccatcgccagcaatattggtggcaagcaggcgctggagacggtgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42425 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctcctgggcctgccaaggcggcgtcctaacgggcctctgggtcatcgcccacgaatgcggccaccacgccttcagcgactac

SEQ ID NO: 42426 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaaggcggccaccacgccttcagcgactac

SEQ ID NO: 42427 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctaaaacgcgtcccctgcgagacaccacccttcactctagacctcaagaaagcaatcccacctcactgcttcaaacgctccatcccacgccccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42428 - DNA, 265 bp, Artificial
  Mutation in BnaC.FAD2.b introduced by TALE nuclease pair BnFAD2_T03
caggatccatgggtgcaggtggcagaatgcaagtctctcctccctccagtctctccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgcctttagcgactac

SEQ ID NO: 42429 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccacctcactgtttcaaacgctcgatccctcgctctttctcctacctcatctgggacatcatcatagcctcctgcttctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42430 - DNA, 396 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctcggcttgaccccccagcaggtggtggccatcgccagcaatggcggtggcaacagccgctggacacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42431 - DNA, 351 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42432 - DNA, 355 bp, Artificial
  Mutation in BnaC.FAD2.b introduced by TALE nuclease pair BnFAD2_T03
caggatccattggtgcaggtggaagaatgcaagtgtctcctccctccaagaagtctgaaaccgacaccatcaagcgcgtaccctgcgagacaccgcccttcactgtcgcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42433 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacacacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgacta

SEQ ID NO: 42434 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatcccacgctccttctcctcttcgacatcatcatctcctcctcgtctcctccctctaccacctctccacagcctacttccctctcccttacctcgcctgacccctctgctgggcctgccaaggctgcgtcctaacgggcctctgggtcatagcccacgagtgcggccaccacgccttcagcgactac

SEQ ID NO: 42435 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagaccccaagaaagcaaccccacctcactgcttcaaacgctccatccctcgctccttctcctacctcccctccgacatcctcgtctccccctccctctaccacctccccaccgcctacttccctctcctcccccaccctctcccttacctcgcctggcccctctactgggcctgccaaggctgcgtcctaacgggcctctgggtcatcgcccacgaaggcggccaccacgccgtcagcgactac

SEQ ID NO: 42436 - DNA, 404 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtctccagcgcctgcttgccgccatcgtggctggcgatggccaccacctgctccggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42437 - DNA, 406 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgggcctggcacagcaccggcaacagccgctggaccgtctccagcgcctgcttgcgagacctcaagaaagcaatcccacctcactgcttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42438 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagggcggccaccacgccttcagcgactac

SEQ ID NO: 42439 - DNA, 432 bp, Artificial
  Mutation in BnaC.FAD2.b introduced by TALE nuclease pair BnFAD2_T03
caggatccatgggtgcaggtggcagaatgcaagtctctcctccctccaagaagtctgaaaccgacaccatcaagcgcgtaccctgcgagacaccaccattcactctcggcctggagacggtccagcggctgttgccggtgctgtgccaggcccacggcttgaccccggagcaggtggcggccatcgccagccacgatggcggagacctcaagaaagcaatcccacctcactgcttcaaacgctccatcccacgctccttcccctcttcgacatcatcatctcctcctcggctcctccctctcccacctctccacagcctacttccctctcccttacctcgcctgacccctctactgggcctgccaaggctgcttcctaacgggcctctgggtcatagcccacgagtgcggcctccacgccttcagcgactac

SEQ ID NO: 42440 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccagggctgcgtcctaaccggcgtctgggtcatagcccacgagtgcggccaccacgcctgcagcgactac

SEQ ID NO: 42441 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactggacctgccaaggctgcgtcctaacgggcctctgggtcatagcccacgagtgcggccaccacgccttcagcgactac

SEQ ID NO: 42442 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaatgctgcgtcctaacgggcctctgggtcatcgcccacgaatgcggccaccacgccttcagcgactac

SEQ ID NO: 42443 - DNA, 442 bp, Artificial
  Mutation in BnaC.FAD2.b introduced by TALE nuclease pair BnFAD2_T03
cggatccatgggtgcaggtggaagaatgcaagtctctactccctccagctcccccgaaaccaaaaccctcaaacgcgtcccctgcgagacaccacccttcactctcctgtcctgatacttgacagcctctccccgcgcgtcgccattgctggcgatggccaccacctgctggggggtcaagccgagggcctggcacagagacctcaagaaagcaatcccacctcactgcttcaaacgctccatccctcgctccctcacctacctcctctacgacatccgcgtcgcctcctccctctaccacctctccacagcctacttccctctcctcccccaccctctcccttacctcgccgggcccctctactgggcctgccaaggctgcgtcctaacgggcctctgggtcatcgcccacgaatgcggccaccacgccttcagcgactac

SEQ ID NO: 42444 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcatcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42445 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42446 - DNA, 317 bp, Artificial
  Mutation in BnaC.FAD2.b introduced by TALE nuclease pair BnFAD2_T03
caggatccatgggtgcaggtggaagaatgcaagtatctcctccatacagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42447 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcggacctcaagaaagcaatcccacctcactgcttcaaacgctccatcccacgctccttctcctcttcgacatcatcatctcctcctcggctcctccctctaccacctctccacagcctacttccctctcccttacctcgcctgaccactctactgggcctgccaaggctgcgtcctaacgggcctctgggtcatagcccacgagtgcggccaccacgccttcagcgactac

SEQ ID NO: 42448 - DNA, 350 bp, Artificial
  Mutation in BnaC.FAD2.b introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgtgttcggccaccacgccttcagcgactac

SEQ ID NO: 42449 - DNA, 321 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacacacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 42450 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaaacgcgtcccctgttatcgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccagcagcgactac

SEQ ID NO: 42451 - DNA, 337 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcactctcgaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 42452 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42453 - DNA, 426 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcaacagccgctggaccgtctccagcgcctgcttgccaccattattgctggcgatggccaccacctgccatcccacgttccagacctcaagaaagcaatcccacctcactgcttcaaacgctccatcccacgctccttctcctcttcgacatcatcatcccctcctccctcaaccaccgctccacagcctacttccctctcctcccccaccctctcccttacctcgcctggcccctctactgggcctgccaaggctgcgtcctaacgggcctctgggtcatcgcccacaaatgcggccaccacgcctgcagcgactac

SEQ ID NO: 42454 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctccaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcgaccaccacgccttcagcgactac

SEQ ID NO: 42455 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttacagcgagcgatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctacgtcctaacgggcctctgggtcatagcccacgagtgcggccaccacgccatcagcgactac

SEQ ID NO: 42456 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctaaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacaaatgcggccaccacgccttcagcgactac

SEQ ID NO: 42457 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42458 - DNA, 331 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccaccattcactcttacagcgagcgatcccacctcactgcttcaaacgctccatcccacgctccttctcctcttcgacatcatcatctcctcctcggctcctccctctaccacctctccacagcatacttccctctcccttacctcgcctgacccctctactgggcctgccaaggctgcgtcctaacgggcctctgggtcatagcccacgagtgcggccaccacgccttcagcgactac

SEQ ID NO: 42459 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 42460 - DNA, 418 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctctccagcggctgttgccggtgctgtgccaggcccacggcttgaccccccagcaggtggtggccatcgccagcaataatggggagacctcaagaaagcaatcccacctcactgcttcaaacgctccatcccacgctccttctcctcttcgacatcatcaccccctccccggctcctccctctcccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 42461 - DNA, 373 bp, Artificial
  Mutation in BnaC.FAD2.b introduced by TALE nuclease pair BnFAD2_T03
caggatccatgagtgcaggtggaagaatgcaagtgtctcctccctccaagaagtctgaaaccgacaacatcaagcgcgtaccctgcgagacactgccaggcatcaaactaagcagaaggccatccgtcaaacgctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42462 - DNA, 337 bp, Artificial
  Mutation in BnaC.FAD2.b introduced by TALE nuclease pair BnFAD2_T03
cagcatccatgggtgcaggtggaagaatgcaagtctctacacactccagctcccccggaaccaacaccctcaaacgagtcccctgcgagacaccaccattcactctaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcattgcccacgagtgcggccaccacgccttcagcgactac

SEQ ID NO: 42463 - DNA, 348 bp, Artificial
  Mutation in BnaC.FAD2.b introduced by TALE nuclease pair BnFAD2_T03
caggatccatgggtgctggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42464 - DNA, 325 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42465 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagcctgcgtcctaacgggcctctgggtcatagcccactagtgcggccaccacgccttcagcgactac

SEQ ID NO: 42466 - DNA, 283 bp, Artificial
  Mutation in BnaC.FAD2.b introduced by TALE nuclease pair BnFAD2_T03
caggatccatgggtgcaggtggaagaatgcaagtgtctcctccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgtgtcatagcccacgagtgcgtccaccacgcctgcagcgactac

SEQ ID NO: 42467 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 42468 - DNA, 261 bp, Artificial
  Mutation in BnaC.FAD2.b introduced by TALE nuclease pair BnFAD2_T03
caggatccatgggtgcaggtggaagaatgcaagtctctcctccctccagtctctccacctcactgcttcaaacgctccatcccacgctccttctcctcttcgacatcatcatctcctcctcggctcctccctctaccacctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42469 - DNA, 383 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaacgaccttttggaaacttcggcttcccctgaaagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42470 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42471 - DNA, 330 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccgacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42472 - DNA, 334 bp, Artificial
  Mutation in BnaC.FAD2.b introduced by TALE nuclease pair BnFAD2_T03
caggatccatgggtgcaggtggaagaatgcaagtttctcctccctccaagacgtctgaaaccgacaccatcaagcgcgtcccctgcgagacaccacccttcactctaactcaagaaagcaatcccacctcacttcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42473 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 42474 - DNA, 317 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42475 - DNA, 328 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcatcccacctcactgcttcaaacgctccatccctcgctccttctcctacctcctcttcgacatcctcgtctcctcctccctctaccacctctccacagcctacttccctctcctcccccaccctctcccttaccccgcctggcccctctactgggcctgccaaggctgcgtcctaacgggcctctgggtcatcgcccacgaatgcggccaccacgccttcagcgacta

SEQ ID NO: 42476 - DNA, 329 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccaccagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 42477 - DNA, 415 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctccagcgcctgcttgccaccattattgctggcgatggccaccacctgctggggggtcaagccgtgacctcaagaaagcaatcccacctcactgcttcaaacgctccatccctcgctccttctcctcttcgacatcatcatctcctcctcggctcctccctctcccacctctccacagcctacttccctctcctcccccaccctcttccttacctcgcctggcccctctactgggcctgccaaggctgcgtcctaacgggcctctgggtcatcgcccacgaatgcggccaccacgccttcagcgactac

SEQ ID NO: 42478 - DNA, 349 bp, Artificial
  Mutation in BnaC.FAD2.b introduced by TALE nuclease pair BnFAD2_T03
caggatccatgggtgcaggtggaagaatgtaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42479 - DNA, 337 bp, Artificial
  Mutation in BnaC.FAD2.b introduced by TALE nuclease pair BnFAD2_T03
caggatccatgggtgcaggtgcaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctactcggctcctccctctaccacctctccacagcctacttccctctcccttacctcgcctgacccctctactgggcctgccaaggcttcgtcctaacgggcctctgggtcatagcccacgagggcggccaccacgccttcagcgactac

SEQ ID NO: 42480 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccacctcaagaaagcaatcccacctcactgcttcaaacgctccatcccaccccccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 42481 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcgtccaccacgcctgcagcgactac

SEQ ID NO: 42482 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgctagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 42483 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42484 - DNA, 303 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccatcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42485 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcctcaagaaagcaatcccacctcactgcttcaaacgctccatccctcgctccttctcctacctcctcttcgacatcctcgtctcctcctccctctaccacttctccacagccaacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 42486 - DNA, 439 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctcgtccagcggctgttgccggtgctgtgccaggcccacggcttgaccccggagcaggtggtggccatcgccagcaatattggtggcaagcaggcgctggcacaaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42487 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagccaccaccattcactctcgggtcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42488 - DNA, 357 bp, Artificial
  Mutation in BnaC.FAD2.b introduced by TALE nuclease pair BnFAD2_T03
caggatccatgggtgcaggtggaagaatgcaagtgtctcctccctccaacaagcctgaaaccgacaccatcaagcgcgtaccctgcgagacaccacccttcactcagacctcaagaaagcaatcccaccgcactgtttcaaacgctcgatccctcgctctttctcctacctcacctgtgacctcatcatagcctcctcggctcctccctctaccacctctccacagcctacttccctctccccccccaccctctcccttacctcgcctggcccctctactgggcctgccaaggctgcgtcctaacgggcctctgggtcatcgcccacgaatgcggccaccacgccttcagcgactac

SEQ ID NO: 42489 - DNA, 335 bp, Artificial
  Mutation in BnaC.FAD2.b introduced by TALE nuclease pair BnFAD2_T03
caggatccatggtgcaggtggaagaatgcaagtctctcctccctccagctcccccggaaccaacaccctcaaacgcgtcccctgcgagacaccaccattcactctagacctcaagaaagcaataccacctcactgcttcaaccgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 42490 - DNA, 303 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacctcactgcttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42491 - DNA, 407 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggtccagcggctgttgccggtgctgggaagccgaagtttccaaaaggtcgttgatcaaacctcaagaaagcaatcccacctcactgcttcacacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42492 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgcctgcagcgactac

SEQ ID NO: 42493 - DNA, 410 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacaggcccacggcttgaccccccagcaggtggtggccatcgccagccacgatggcggcaaagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42494 - DNA, 274 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacctcactgcttcaaacgctccatcccacgctccttctcctcttcgacatcatcatctcctcctcggctcctccctctaccacctctccacagcctacttccctctccattacctcgcctgacccctctactgggcctgccaaggctgcgtcctaacgggcctctgggtcatagcccacgagtgcggccaccacgccttcagcgactac

SEQ ID NO: 42495 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgtgcctctgggtcatagcccacgagtgcggccaccacgccttcagcgactac

SEQ ID NO: 42496 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 42497 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaaggctgcgtcctaacgggcctctgggtcatcgcccacgaatgcggccaccacgccttcagcgactac

SEQ ID NO: 42498 - DNA, 354 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactctcgggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42499 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42500 - DNA, 346 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42501 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttacctcaagaaagcaatcccacctcactgcttcaaacgctccatccctcgctccttctcctacctcctcttcgacatcctcgtctcctcctccctctaccacctctgcacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 42502 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42503 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 42504 - DNA, 372 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactctcggcgggtgtggtggttacgtagacctcaagaaagcaagcccacctcactgcttcaaacgctccatcccacgctccttctcctcttccacatcatcatctcctcctcggctcctccctctcccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42505 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 42506 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaacaaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccatctcccttacctcgcctgacccctctactgggcctgccaaggctgcgtcctaacgggcctctgggtcatagcccacgagtgcggccaccacgccttcagcgactac

SEQ ID NO: 42507 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcggcctaacgggcctctgggtcatagcccacaagtgcggcctccacgccagcaacgactac

SEQ ID NO: 42508 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcagacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccgcagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42509 - DNA, 345 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcacttcggagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42510 - DNA, 330 bp, Artificial
  Mutation in BnaC.FAD2.b introduced by TALE nuclease pair BnFAD2_T03
caggatccatgggtgcaggtggaagaatgcaagtctctcctccctccagctccccctgaaccaacaccctcaaacgcgtcccctgcgagacaccaccattagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctctgggtcatagcccacgagtgcggccaccacgccttcagcgactac

SEQ ID NO: 42511 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaggcgctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 42512 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgtgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42513 - DNA, 446 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttggcggcaagcaggcgctggagacggtccagcggctgttgccggtgctgtgccaggcccacggcactaccccggagcaggtggtggccattgccggagacctcaagaaagcaatcccacctcactgcttcaaacgctccatccctcgctccttctcctccctcccctccgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42514 - DNA, 329 bp, Artificial
  Mutation in BnaC.FAD2.b introduced by TALE nuclease pair BnFAD2_T03
caggatccatgggtgcaggtggaagaatgcaagtatctcctccctccagctcccccgaaaccaaaaccctcaaacgcgtcccctgcgagacaccatggcggacctcaagaaagcaatcccaccttactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactgc

SEQ ID NO: 42515 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaacactcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacggcctacttccctctcctcccccaccctctcccttacctcgcctggcccctctactgggcctgccaaggctgcgtcctaacgggcctctgggtcatcgcccgcgaatgcggccaccacgccttcagcgactcc

SEQ ID NO: 42516 - DNA, 367 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttgagcggggcacccgtcagtgcattgcgccagagaactcaagaaagcaatcccaccgcactgtttcaaacgctcgatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42517 - DNA, 336 bp, Artificial
  Mutation in BnaC.FAD2.b introduced by TALE nuclease pair BnFAD2_T03
caggatccatgggtgcagggggaagaatgcaagtctctcctccctccagctcccccgaaaccaaaaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcggcctaacgggcctctgggtcatagcccacaagtgcggccaccacgccatcagcgactac

SEQ ID NO: 42518 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttagacctcaagaaagcaatcccacctcactgcttcaaacgctccatccctcgctccttctcctacctcctcttcgacatcctcgtctcctcctccctctaccacctctccacagcctacttccctctcctcccccaccatctcccttacctcgcctggcccctctactgggcctgccaaggctgcgtcctaacgggcctctgggtcatcacccacgaatgcggccaccactccttcagcgactac

SEQ ID NO: 42519 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 42520 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtcctaacgggcctctgggtcatagcccacgagtgcggccaccacgccttcagcgactac

SEQ ID NO: 42521 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgtggccaccacgccttcagcgactac

SEQ ID NO: 42522 - DNA, 327 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagaaagcaatcccacctcactgcttcaaacgctccatccctcgctccttctcctatctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42523 - DNA, 356 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggggagacctcaagaaagcaatcccacctcactgcttcaaacgctccatccctcgctccttctcctacctcctcttcgacatcctcgtctcctcctccctctaccacctctccacagcctacttccctctcctcccccacccgctcccttaccgcgcctggcccctctactgggcctgccaaggctgcgtcctaacgggcctctgggtcatcgcccacgaatgcggccaccacgccttcagcgactac

SEQ ID NO: 42524 - DNA, 438 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggcaacagccgctggaccgttgctgtgccaggcccacggcttgaccccccagcaggtggtggccatcgccagcaatggcggtggcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42525 - DNA, 395 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtgccaggcccacggcttgaccccccagcaggtggtggccagagacctcaagaaagcaatcccacctcactgcttcaaacgctccatcccacgctccttctcctcttcgacatcatcatctcctcctcggctcctccctctaccacccctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42526 - DNA, 349 bp, Artificial
  Mutation in BnaC.FAD2.b introduced by TALE nuclease pair BnFAD2_T03
caggatccatgggtgcaggtggaagaatgcaagtctctcctcccttcagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 42527 - DNA, 423 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctctccagcggctgttgccggtgctgtgccaggcccacggcttgaccccccagcaggtggtggccatcgccagcgagacctcaagaaagcaatcccacctcactgcttcaaacgctccatccctagctccttctcctacctcctcttcgccatcctcgtctcctcctccctctaccacctctccacagcctacttccctctcctccccccccctctcccttacctcgcctgacccctctactgggcctgccaaggctgcgtcctaacgggcctctgggtcatagcccacgagtgcggccaccacgccttcagcgactac

SEQ ID NO: 42528 - DNA, 351 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 42529 - DNA, 404 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctccagcgcctgcttgccgccatcgtggctggcgatggccaccacctgctccggagaactcaagaaagcaatcccacctcactgcttcaaacgctccatccctcgctccttctcctacctcctcttcgacatcctcgtctcctcctccctctcccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42530 - DNA, 332 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactacctcaagaaagcaatcccacctcactgcttcaaacgctccatcccacgctccttctcctcttcgacatcatcatctcctcctcggctcctccctctaccacctctccacagcctacttccctctcccttccctcgcctgacccctctacggggcctgccaaggcggcggcctaacgggcctctgggtcatagcccacgagtgcggccaccacgccctcagcgactac

SEQ ID NO: 42531 - DNA, 357 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcggtcggagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42532 - DNA, 321 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccataaaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 42533 - DNA, 334 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaaggcggccaccacgccttcagcgactac

SEQ ID NO: 42534 - DNA, 420 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggaccgtctccagcgcctgcttgccaccgccattgctggcgatggccaccacctgctggggggtcaagccgtgggcctggcggagacctcaagaaagcaatcccacctcactgcttcaaacgctccatcccacgctccttctcctcttcgacatcatcacctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42535 - DNA, 335 bp, Artificial
  Mutation in BnaC.FAD2.b introduced by TALE nuclease pair BnFAD2_T03
caggatccatgggtgcaggtggaagaattcaagtctctcctccctccagctcccccggaaccaacaccctcaaacgcgtcccctgcgagacaccaccattcactctagacctcaagaaagcaatcccacctcactgcttcaaacgctccatcccacgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42536 - DNA, 352 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42537 - DNA, 422 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctatctccagcggctgttgccaccgccattgctggcgatggccaccacctgctggggggtcaagccgtgggcctggcacagcaccgggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42538 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42539 - DNA, 282 bp, Artificial
  Mutation in BnaC.FAD2.b introduced by TALE nuclease pair BnFAD2_T03
caggatccatgggtgcaggtggaagaatgcaagtctctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctggttcatcgcccacgaatgcggccaccacgccttcagcgactac

SEQ ID NO: 42540 - DNA, 266 bp, Artificial
  Mutation in BnaC.FAD2.b introduced by TALE nuclease pair BnFAD2_T03
caggatccatgggtgcaggtggaagaatgcaagtctcgacctcaagaaagcaatcccacctcactgcttcaaacgctccatccctcgctccttctcctcttcgacatcatcatctcctcctcggctcccccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42541 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcctctgggtcatagcccacgagtgcggccaccacgccttcagcgactac

SEQ ID NO: 42542 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggcggagacctcaagaaagcaatcccacctcactgcttcaaacgctccatcccacgcttcttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42543 - DNA, 343 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactctagacctcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42544 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggaaagcaatcccacctcactgcttcaaacgctccatcccacgctccttctcctcttcgacatcatcatctcctcctcggcttctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42545 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccctaccctctcccttacctcgcctggcccctctactgggcctgccaaggctgcgtcctaacgggcctctgggtcatcgcccacgaatgcggccaccacgccttcagcgactac

SEQ ID NO: 42546 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacccccaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42547 - DNA, 350 bp, Artificial
  Mutation in BnaC.FAD2.b introduced by TALE nuclease pair BnFAD2_T03
caggatccatgggtgcaggtggaagaatgcaagtctctactccctcaagctcccccggaaccaacaccctcaaacgcgtcccctgcgagaaaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatccggccaccacgccttcagcgactac

SEQ ID NO: 42548 - DNA, 345 bp, Artificial
  Mutation in BnaC.FAD2.b introduced by TALE nuclease pair BnFAD2_T03
caggatccatgggtgcaggtggaagaatgcaagtctctcctccctccagctaccccggaaccaacaccctcaaacgcgtaccctgcgagacaccaccattgagacctcaagaaagcaatccaacctcactgcttcaaacgttcaatccctcgctccttctcctacctccccttcgacatcctcgtctcctcctccctctaccacctctccacatcctacttccctatcctcccccaccctctcccttacctcgcctggcccctctactgggcctgccaaggctgcgtcctaacgggcctctgggtcatcgcccacgaatgcggccaccacgccttcagcgactac

SEQ ID NO: 42549 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctagacctcaagaaagcaatcccacctcactgcttcaaacgctccatcctacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42550 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 42551 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42552 - DNA, 347 bp, Artificial
  Mutation in BnaC.FAD2.b introduced by TALE nuclease pair BnFAD2_T03
caggatccatgggtgcaggtggaagaatgcaagtatctcctccctccaagaagtctgaaaccgacaccatcaagcgcgtaccctgcgagacaccgcccttcactagaactcaagaaagcaatcccacctcactgcttcaaacgccccatcccacgctccttctcctacctcctcttcgacatcctcgtctcctcctccctctcccacctctccacagcctactcccctctcctcccccaccctctcccttccccccccggcccctctactgggcctgccaaggctgcgtcctaacgggcctctgggtcatcgcccacgaatgcggccaccacgccttcagcgactac

SEQ ID NO: 42553 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42554 - DNA, 331 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 42555 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42556 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccacctcactgcttcaaacgctccatccctcgctccttctcctaccacctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42557 - DNA, 342 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccagaactcaagaaagcaatcccaccgcactgtttcaaacgctcgatccctcgctctttctcctacctcatctgggacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42558 - DNA, 423 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctctgggtggccatcgccagcaatggcggtggcaagcaggcgctggcgacggtccagcggctgttgccggtgcggagacctcaagaaagcaatcccacctcactgcttcaaactctccatccctcgctccttctcctccctcctcttcgacatcctcctctcctcctccctctaccccctccccacagcctacttccctctcctccccccccctctcccttacctcgcctggcccctctactgggcctgccaaggctgcgtcctaacgggcctctggttcatcgcccacgaatgcggccaccacgccttcagcgactac

SEQ ID NO: 42559 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgggacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccgtcagcgactac

SEQ ID NO: 42560 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42561 - DNA, 302 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcaagacagcaatcccaccacactgcttcaaacgctccatcccacgctccttctcctcttcggcctcctcatctcccccccggctcctccctcaccctctctcctacttcgcctggcctctctactgggcctgccaagggtgcgtcctaaccggcgtctgggtcatagcccacgagtgcggccaccacgccttcagcgactac

SEQ ID NO: 42562 - DNA, 347 bp, Artificial
  Mutation in BnaC.FAD2.b introduced by TALE nuclease pair BnFAD2_T03
caggatccatgggtgcaggtggaagaatgcaagtctctcctcccttcagctcccccgaaaccaaaaccctcaaccgcgtcccctgtgagataccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcagagcccacgagtgcggccgccactccttcagcgactac

SEQ ID NO: 42563 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccacctcactgcttcaaacgctccatcccacgctccttctcctcttcgacatcatcatctcctcctcggctcctccctctacctcctctccacagcctccttccctctcccttacctcgcctgacccctctactgggcctgccaaggctgcgtcctaacgggcctctgggtcatagcccacgagtgcggccaccacgccttcagcgactac

SEQ ID NO: 42564 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccctcaagaaagcaatcccacctcactgcttccaacgctccatccctcgctccttctccgacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42565 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaccgcgtcccctgcaagacaccaccattcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 42566 - DNA, 280 bp, Artificial
  Mutation in BnaC.FAD2.b introduced by TALE nuclease pair BnFAD2_T03
caggatccatgggtgcaggtggcagaatgcaagtctctcctccctccagtctctccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 42567 - DNA, 337 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactacc

SEQ ID NO: 42568 - DNA, 317 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacggggctctgggtcatagcccacgagtgcggccaccacgccttcagcgactac

SEQ ID NO: 42569 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggatgcgtcctaacgggcctctgggtcatcgcccacgaatgcggccaccacgccttcagcgactac

SEQ ID NO: 42570 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggcttcggcctaacgggcctctgggtcatcgcccacgaattcggccaccacgccttgagcgactac

SEQ ID NO: 42571 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcaagaaagcaatcccacctcactgcttcaaacgctccatcccacgctccttctcctcttcgacatcatcatctcctcctcggctcctccctctaccacctctccacagcctacttccctctctcctacttcgcctggcccctctactgggcctgccaaggctgcgtcctaacgggcctctgggtcatcgcccacgaatgcggccaccacgccttcagcgactac

SEQ ID NO: 42572 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcataacgggcctctgggtcatcgcccacgaatgcggccaccacgccttcagcgactac

SEQ ID NO: 42573 - DNA, 443 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttccagcgcctgcttgccaccattattgctggcgatggccaccacctgctggggggtcaagccgtgggcctggcacagcaccggcaacagccggagacctcaagaaagcaatcccacctcactgcttcaaacgctccatccctcgctccttctcctacctcctctccgacatcctcgtctcctcctccctctaccacctctccacagcctacttccctcccctcccccaccctctcccttacctcgcctggcccctctactgggcctgccaaggctgcgtcctaacgggcctctgggtcatagcccacgagtgcggccaccacgccttcagcgactac

SEQ ID NO: 42574 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaaggcggccaccacgccttcagcgactac

SEQ ID NO: 42575 - DNA, 342 bp, Artificial
  Mutation in BnaC.FAD2.b introduced by TALE nuclease pair BnFAD2_T03
caggatccatgggtgcaggtggaagaatgcaagtgtctcccccctccaaaaagtctgaaaccgacaccatcaagcgcgtaccctgcgagacaccgcccttcactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagtgactac

SEQ ID NO: 42576 - DNA, 346 bp, Artificial
  Mutation in BnaC.FAD2.b introduced by TALE nuclease pair BnFAD2_T03
caggatccatgggtgcaggtgcaagaatgcaagtctctcctccctccagctcccccggaaccaacaccctcaaacgcgtcccctgcgagacaccaccattcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccccggcccctctaccgggcctgccaaggctgcgtcctaacgggcctctgcgtcatcgcccacgaatgcggccaccacgccttcagcgactac

SEQ ID NO: 42577 - DNA, 281 bp, Artificial
  Mutation in BnaC.FAD2.b introduced by TALE nuclease pair BnFAD2_T03
caggatccatgggtgcaggtggcagaattcaagtttctcatccctccaggtagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagttcggccaccacgccttcagcgactac

SEQ ID NO: 42578 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccatcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 42579 - DNA, 336 bp, Artificial
  Mutation in BnaC.FAD2.b introduced by TALE nuclease pair BnFAD2_T03
caggatccttgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42580 - DNA, 340 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggctaccacgccttcagcgactac

SEQ ID NO: 42581 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaacgggcctctgggtcatcgcccacgaatgcggccaccacgccttcagcgactac

SEQ ID NO: 42582 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcacggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42583 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagccaccaccattcactggagacctcaagaaagcaatcccacctcactgcttcaaacgctccatcccacgctccttctcctcttcgacatcatcatctcctcctcggctcctccctctaccacctctccacagcctacttccctctcccttacctcgcctgaccccgctactgggcctgccaaggctccgtcctaacgggcctctgggtcatagcccacgagtgcggccaccacgccttcagcgactac

SEQ ID NO: 42584 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacaaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtactaacgggcctctgggtcatagcccacgagtgcggccaccacgccttcagcgactac

SEQ ID NO: 42585 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42586 - DNA, 333 bp, Artificial
  Mutation in BnaC.FAD2.b introduced by TALE nuclease pair BnFAD2_T03
caggatccatgggtgcaggtggaagaatgcaagtatctcctccctccagctcccccggaaccaaaaccctcaaacgcgtcccctgcgagacaccacccttcactcgacatcaagaaagcaatcccacctcactgcttcaaacgctccatccctcgctccttctcctacctcctcttcgacatcctcgtctcctcctccctctaccacctctccacagcctacttccctctcccttacctcgcctgacccctctcctgggcctgccaaggctgcgtcctaacgggcctctgggtcatagcccacgagtgcggccaccacgccttcagcgactac

SEQ ID NO: 42587 - DNA, 326 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcacaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42588 - DNA, 347 bp, Artificial
  Mutation in BnaC.FAD2.b introduced by TALE nuclease pair BnFAD2_T03
caggatccatgggtgcaggtcgaagaatccaagtatctcctccctccagctcccccggaaccaacaccctcaaacgcgtcccctgcgagacaccaccattcactctcctcaagaaagcaatcccacctcactgcttcaaacgctccatctcacgctccttctcctacctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 42589 - DNA, 357 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42590 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42591 - DNA, 337 bp, Artificial
  Mutation in BnaC.FAD2.b introduced by TALE nuclease pair BnFAD2_T03
caggatccatgggtgcaggtggcagaatgcaagtctctcctccctccagctcacccggaaccaacaccctaaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcccctgacccctctactgggcctgccaaggctacggcctaacgcgcctctggcacatagcccacgagtgcggtcaccacgcccccagcgactac

SEQ ID NO: 42592 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42593 - DNA, 335 bp, Artificial
  Mutation in BnaC.FAD2.b introduced by TALE nuclease pair BnFAD2_T03
caggatccatgggtgcaggtggaagaatccaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccgcagccttcttccctctcccttacctcgcctgacccctctactgggcctgccaaggctgcgtcctaacgggcctctgggtcatagcctactggtgcggccaccacgccttcagcaactac

SEQ ID NO: 42594 - DNA, 356 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgtcaaggctgcgtcctaacgggcctctgggtcatcgcccacgaatgcggccaccacgccttcagcgactac

SEQ ID NO: 42595 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcaacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagtgctgcgtcctaaccggcgtctgggtcatagcccacgagtgcggccaccacgccttcagcgactac

SEQ ID NO: 42596 - DNA, 300 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctcccccaccctctcccttacctcgcctggcccctctactgggcctgccaaggctgcgtcctaacgggcctctgggtcatcgcccacgaatgcggccaccacgccttcagcgactac

SEQ ID NO: 42597 - DNA, 348 bp, Artificial
  Mutation in BnaC.FAD2.b introduced by TALE nuclease pair BnFAD2_T03
caggatccatggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42598 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctaaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 42599 - DNA, 351 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgtgcctctgggtcatcgcccacgaatgcggccaccacgccttcagcgactac

SEQ ID NO: 42600 - DNA, 299 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42601 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42602 - DNA, 454 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcccccccagcaggtggtggccatcgccagcaatggcggtggcaagcaggcgctggagacggtccttgaacgttgtgaagcaacggcccggaggggggcgggcaccccccccgccataaactaccaggcatcaagaaagcaaacccaccgcactgcttcaaacgctccaccccccgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42603 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaaccggcgtctggatcatagcccacgagtgcggccaccacgccttcagcgactac

SEQ ID NO: 42604 - DNA, 381 bp, Artificial
  Mutation in BnaC.FAD2.b introduced by TALE nuclease pair BnFAD2_T03
caggatccatgggtcaggtggaagaatgcaagtctctcctccctccagctcccccggaaccaacaccctcaaacgcgtcccctggcgatggccaccaccattcactcggggggtcaagccgtgggcctggcacagcaccggcaacagccgcagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42605 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcttggtcatcgcccacgaatgcggccaccacgccttcagcgactac

SEQ ID NO: 42606 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgtagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactggtcctgccaaggctgcgtcctaacgggcctctgggtcatcgcccacgaatgcggccaccacgccttcagcgactac

SEQ ID NO: 42607 - DNA, 332 bp, Artificial
  Mutation in BnaC.FAD2.b introduced by TALE nuclease pair BnFAD2_T03
caggattgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42608 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactcacgaaagcattcccacctcaatgcttccaccccgccacccccccccccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 42609 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgcgcctggcccctctactgggcctgccaaggctgcgtcctaacgggcctctgggtcatcgcccacgaatgcggccaccacgccttcagcgactac

SEQ ID NO: 42610 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgtgcctctgggtcatagcccacgaggtcggccaccacgccttcagcgactac

SEQ ID NO: 42611 - DNA, 317 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42612 - DNA, 354 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgggagaactcaagaaagcaattccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42613 - DNA, 330 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagaactcaagaaagcaatcccaccgcactgtttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42614 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgctgccaccacgccttcagcgactac

SEQ ID NO: 42615 - DNA, 279 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 42616 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcctacgagtgcggccaccacgccttcagcgactac

SEQ ID NO: 42617 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 42618 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctagacctcaagaaagcaatcccacctcactgcttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42619 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42620 - DNA, 387 bp, Artificial
  Mutation in BnaC.FAD2.b introduced by TALE nuclease pair BnFAD2_T03
caggatccatgggtgcaggtggaagaatgcaagtctctcctacctccagctcccccggaaccaacaccctcaaacgcgtcccctgcgagacaccaccattcactcttgaccccggagcaggtggtggccatcgccagccacgatggcggcaagcaggcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42621 - DNA, 336 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42622 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42623 - DNA, 346 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42624 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccagagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42625 - DNA, 337 bp, Artificial
  Mutation in BnaC.FAD2.b introduced by TALE nuclease pair BnFAD2_T03
cagtatccatgggtgcaggtggaagaatgcaagtgtctcctccctccaaaaagtctgaaaccgacaacatcaagcgcataccctgcgagacaccgcgggcctggcacagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42626 - DNA, 266 bp, Artificial
  Mutation in BnaC.FAD2.b introduced by TALE nuclease pair BnFAD2_T03
caggatccatgggtgcaggtggaagaatgcaagtctcgacctcaagaaagcaatcccacctcactgcttcaaacgctccatcccacgctccttctcctcttcgacatcatcatctcctcctcggctcctccctctaccacctctccacagcctacttccctctcccttacctcgcctaacccctctactgggcctgccaaggctgcgtcctaacgggcctctgggtcatagcccacgagtgcggccaccacgccttcagcgactac

SEQ ID NO: 42627 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 42628 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaatgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42629 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtaatcgcccacgaatgcggccaccacgccttcagcgactac

SEQ ID NO: 42630 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccatctcccttacctcgcctgacccctctactgggcctgccaaggctgcgtcctaacgggcctctgggtcatagcccacgagtgcggccaccacgccttcagcgactac

SEQ ID NO: 42631 - DNA, 350 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcggggtcatcgcccacgaatgcggccaccacgccttcagcgactac

SEQ ID NO: 42632 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaataaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42633 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgccccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42634 - DNA, 449 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctcgggtgttggcttaacgcaacgatgtgcgcgtgtgtaaacccgtggccgaccagtgcctcgtggtgcaggtggtggccatcgccagccacgatggcggcaacagccgctggaccgacctcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42635 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42636 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42637 - DNA, 330 bp, Artificial
  Mutation in BnaC.FAD2.b introduced by TALE nuclease pair BnFAD2_T03
caggatccatgggtgcaggtggaagaatgcaagtctctcctccccccagctcccccggaaccaacaccctcaaacgcgtcccctgcgagacaccaccattcaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagggcggccaccacgcctgcagcgactac

SEQ ID NO: 42638 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42639 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctaggtcatagcccacgagtgcggccaccacgccttcagcgactac

SEQ ID NO: 42640 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgagtgcggccaccacgccttcagcgactac

SEQ ID NO: 42641 - DNA, 346 bp, Artificial
  Mutation in BnaC.FAD2.b introduced by TALE nuclease pair BnFAD2_T03
caggatccatgggtgcaggtgaaagaatgcaagtctctcctccctccagctcccccgaaaccaaaaccctcaaacgcgtcccctgcgagacaccacccttcactctgtagagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 42642 - DNA, 460 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctctccagcgcctgcttgccgccatcgtggctggcgatggccaccacctgctccggggtcaagccgtgggcctggcacagcaccggcaacagccgctggaccgtccccagcgcctgttgccgccagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42643 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctatcgggcctctgggtcatcgcccacgaatgcggccaccacgccttcagcgactac

SEQ ID NO: 42644 - DNA, 349 bp, Artificial
  Mutation in BnaC.FAD2.b introduced by TALE nuclease pair BnFAD2_T03
caggatccatgggtgcaggtagaagaatgcaagtctctcctccctccagctcccccgaaaccaaaaccctcaaacgcgtcccctgcgagacaccacccttcactcgaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42645 - DNA, 338 bp, Artificial
  Mutation in BnaC.FAD2.b introduced by TALE nuclease pair BnFAD2_T03
caggatccatgggtgcaggtgcaagaatgcaagtctctactccctccagctcccccgaaaccaaaaccctcaaacgcgtcccctgcgagacaccacccttcactaaagcaatcctacctcacttcttcaaacgctccatcccacgctccttctcctacctcatctgggacatcatcatagcctcctgcttctactacgtcgccaccacttacttccctctcctcccccaccctctcccttacctcgcctggcccctctactgggcctgccaaggctgcgtcctaacgggccgctgggtcatagcccacgagtgcggccaccacgccttcagcgactac

SEQ ID NO: 42646 - DNA, 454 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcttgaccccccagcaggtggtggccatcgccagcaataatggtggcaagcaggcgctggagacggtccagcggctgttgaaccgctcgccgcagccgaacgaccgagcgcagcgggtcagtgagcgaggaagctatcccacctcactgcttcaaacgctccatcccacgctccttctcctcttcgacatcatcatctcctcctcggctcctccctctcccacctctccacagcctacttccctctcccttacctcgcctggcccctctactgggcctgccaaggctgcgtcctaacgggcctcggggtcatcgcccacgaatgcggccaccacgccttcagcgactac

SEQ ID NO: 42647 - DNA, 324 bp, Artificial
  Mutation in BnaC.FAD2.b introduced by TALE nuclease pair BnFAD2_T03
caggatccatgggtgcatgtggaagaatgcaagtctctcctccctccagctcccccggaaccaacaccctcaaacgcgtcccctgcgagacaccaccattcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42648 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42649 - DNA, 334 bp, Artificial
  Mutation in BnaC.FAD2.b introduced by TALE nuclease pair BnFAD2_T03
caggatccatggtgcaggtggaagaatgcaagtctctcctccctccagctcccccggaaccaacaccctcaaacgcgtcccctgcgagacaccaccattcacggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 42650 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaaacaatcccacctcactgcttcaaaccctccatcccaccccccttctcctcttcgacatcatcatctcctcctcggctcctccctctaccacctccccacagcccccttccctctcccttacctcgcctgacccctctactgggcctgccaaggctgcgtcctaacgggcctctgggtcatagcccacgaatgcggccaccacgccttcagcgactac

SEQ ID NO: 42651 - DNA, 345 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 42652 - DNA, 321 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccataaaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42653 - DNA, 473 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcaaagctcgccgcgttgtttcatcaagccttaagggcgcgatcgttcaaacattcggcaataaagcgatgaccaccacctgctggggggtcaagccgtgggcctggcacagcaccggcaacagagacctcaagaaagcaatcccacctcactgcttcaaacgctccatccctcgctccttctcctacctcctctccgacatcctcgtctcctcctccctctaccccctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42654 - DNA, 342 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaaacgcgtaccctgcgagacaccgcccttcactctcggcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42655 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactacc

SEQ ID NO: 42656 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctggttcatagcccacgagtgcggccaccacgtctgcagcgactac

SEQ ID NO: 42657 - DNA, 327 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccgaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42658 - DNA, 278 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcgacatcctcgtctcctcctccctctaccacctctccacagcctacttccctctcctcccccaccctctcccctacctcgcctggcccctctactgggcctgccaaggctgcgtcctaacgggcctctgggtcatcgcccacgactgcggccaccacgccttcagcgactac

SEQ ID NO: 42659 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42660 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccaccctccttctcctcttcgacttcatcatctcctcctcgtctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 42661 - DNA, 345 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 42662 - DNA, 474 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctctccagcgcctgcttgccgccatcgtggctggcgatggccaccacctgctccggggtcaagccgtgggcctggcacagcaccggcaacagccgctggaccgtctccagcgcctgttgccgccagagacctcaagaaagcaatcccacctcaccgcttcaaacgctccatccctcgctccttctcctcccccctctccgacatcctcgtcccctcctccctctcccacctctccacagcctacttccctctcctcccccaccctctcccttacctcgcccggcccctctactgggcgtgccaaggctgcgtcctaacgggcctctgggtcatcgcccacgaatgcggccaccacgccttcagcgactac

SEQ ID NO: 42663 - DNA, 376 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggtggccatcgccagcaatggcggtggcaacagccgctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42664 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccaccctccttctcctcttcgacatcatcatctcctcctcggcgcctccctctaccacctctccacatcctacttccctctcccttacctcgcctgacccctctactgggcctgccaaggctgcgtcctaacgggcctctgggtcatagcccacgagtgcggccaccacgccttcagcgactac

SEQ ID NO: 42665 - DNA, 304 bp, Artificial
  Mutation in BnaC.FAD2.b introduced by TALE nuclease pair BnFAD2_T03
caggaccatgggtgcaggtggaagaatgcaagtctctcctccctccagctcccccggaaccaacaccctcaaacgcgtcccctgcgagacaccaccattcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42666 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42667 - DNA, 265 bp, Artificial
  Mutation in BnaC.FAD2.b introduced by TALE nuclease pair BnFAD2_T03
caggatccatgggtgcaggtggaagaatgcaagtctctcctccctccagtctctccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 42668 - DNA, 356 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcctctctactgggcctgccaagggtgcgtcctaaccggcgtctgggtcatagcccacgagtgcggccaccacgccttcagcgactac

SEQ ID NO: 42669 - DNA, 336 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactctagacctcaagaaagcaatcccaccgcactgtttcaaacgctccatcccacgctccttctcctcttcgacatcatcatctcctcctcggctcctccctctaccacctctccacagcctacttccctctcccttacctcgcctggcccctctactgggcctgccaagggtgcgtcctaaccggcgtctgggtcatagcccacgagtgcggccaccacgccttcagcgactac

SEQ ID NO: 42670 - DNA, 336 bp, Artificial
  Mutation in BnaC.FAD2.b introduced by TALE nuclease pair BnFAD2_T03
caggatccatgtgtgcaggtggaagaatgcaagtctctcctccctccagctcccccggaaccaacaccctcaaacgcgtcccctgcgagacaccaccattcacatgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaacgggcctctgggtcatagcccacgagtgcggccaccacgccttcagcgactac

SEQ ID NO: 42671 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacacaatcaagcgcgtaccctgcgagacaccacccttcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgattac

SEQ ID NO: 42672 - DNA, 456 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggcaggtggtggccatcgccagcaatattggtggcaagcaggcgctggagacggtgcaggcgctgttgccggtgctgtgccaggcccacggcttgaccccggagcaggtggctggcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 42673 - DNA, 316 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaactcctccctcggagacctcaagaaagcaatcccacctcacttcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 42674 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 42675 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggagagcgttcaccgacaaacaacagataaaacgaaaggcccagtcacctcaagaaagcaatcccacctcactgcttcaaacgctccatcccacgctccttctcctcttcgacatcatcatctcctcctcggctcctccctctaccacctctccccagcctacttccctctcctcccccaccctctcccttacctcgcctggcccctctactgggcctgccaagactgcgtcctaacgggcctctgggtcatcgcccacgaatgcggccaccacgccttcagcgactac

SEQ ID NO: 42676 - DNA, 399 bp, Artificial
  Mutation in BnaC.FAD2.b introduced by TALE nuclease pair BnFAD2_T03
caggtccatgggtgcaggtggaagaatgcaagtctctcctccctccagctcccccggaaccaacaccctcaaacgcgtcccctgcgagacaccaccattcactctcggagacggtccagcggctgttgccggtgctgtgccaggcccacggtccagcggctgttgccagagacctcaagaaagcaatcccacctcactgcttcaaacgctccatcccacgctccttctcctcttcgacatcatcatctcctcctcggctcctccctctcccccctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42677 - DNA, 342 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcggcctaacgggcctctgggtcatcgcccacgaatgcggccaccacgccttcagcgactac

SEQ ID NO: 42678 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgcaccatcccacgctccttctcctacctcctcttcgacatcctcgtctcctcctccctctaccacctctccacagcctacttccctcccctcccccaccctctcccttacctcgcctggcccctctactgggcctgccaaggctgcgtcctaacgggcctctgggtcatcgcccacgaatgcggccaccacgccttcagcgactac

SEQ ID NO: 42679 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42680 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctttcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42681 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 42682 - DNA, 332 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgccagacctcaagaaagcaatcccacctcactgcttcaaacgcttcatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42683 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcatcccctgcgagacaccaccattcaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgcctgcagcgactac

SEQ ID NO: 42684 - DNA, 342 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcatcatctccgcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42685 - DNA, 336 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42686 - DNA, 401 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctggcaacgctgcgatcatgtcctgatacttgacagcgacggtccctatcgcagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 42687 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 42688 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctaaaacgcgtcccctgcgagacaccaccattcactctagacctcaagaaagcaatcccaactcactgcttcaaacgctccatcccacgctccttctcctcttcgacatcatcatctcctcctcggctcctccctctaccacctctccacagcctacttccctctcccttacctcgcctggcctctctactgggcatgccagggctgcgtcctaaccggcgtctgggtcatagcccacgagtgcggccaccacgccttcagcgactac

SEQ ID NO: 42689 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactgaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42690 - DNA, 363 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcggcgggtgtgggggttacgcgcaaagacctcaagaaagcaatcccacctcactgcttcaaacgctccatcccacgctccttctcctcttcgacctcatcatcccctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42691 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattgagcggatttgtcctactcaggagagcgttcacagacaaacaacagataaaacgaaaggcccagtcttccctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42692 - DNA, 400 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctggcaacgctgcgatcatgtcctgatacttgacagcgacggtccctttcgcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42693 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcatcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccaggagtgcggccaccacgccttcagcgactac

SEQ ID NO: 42694 - DNA, 274 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacggacctctgggtcatagcccacgaatgcggccaccacgccttcagcgactac

SEQ ID NO: 42695 - DNA, 351 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccacctcactgcttcaaacgctccctccctcgctccttctcctacctcctcttcgacatcctcgtctcctcctccctctaccacctctccacagcctacttccctctcctcccccaccctctcccttgcctcgcctggcccctctactgggcctgccaaggctgcgtcctaacgggcctctgggtcatcgcccacaaatgcggccaccacgccttcagcgactac

SEQ ID NO: 42696 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccacgaaaccaaaaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 42697 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattagacctcaagaaagcaatcccacctcactgcttcaaacgctccatcccacgctccttctcctcttcgacatcatcatctcctcctcggctcctccctctaccacctctccacagcctacttccctctccattacctcgcctgacccctctactgggcctgccaaggctgcgtcctaacgggcctctgggtcatcgcccacgaatgcggccaccacgccttcagcgactac

SEQ ID NO: 42698 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactcgagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42699 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgccccatcccacgccccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42700 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagggcggccaccacgccttcagcgactac

SEQ ID NO: 42701 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactatcccacctcactgcttcaaacgctccatccctcgctccttctcctccctcctcttcgacatcctcgtctcctcctccctctaccacctctccacagcctacttccctctcctccctcaccctctctcctacttcgcctggcctctctactgggcctgccagggctgcgtcctaaccggcgtcggggtcatagcccacgagtgcggccaccacgccttcagcgactac

SEQ ID NO: 42702 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42703 - DNA, 337 bp, Artificial
  Mutation in BnaC.FAD2.b introduced by TALE nuclease pair BnFAD2_T03
cagatccatgggtgcaggtggaagaatgcaagtctctcctccctccagctcccccggaaccaacaccctcaaacgcgtcccctgcgagacaccaccattcactctagagacctcaagaaagcaatcccacctcactgcttcaaacgctccatcccacgctccttctcctcttcgacatcatcatctcctcctcggctcctccctctaccacatctccacagcctacttccctctcccttacctcgcctgacccctctactgggcctgccagggctgcgtcctaaccggcgtctgggtcatagcccacgagtgcggccaccacgccttcagcgactac

SEQ ID NO: 42704 - DNA, 329 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaaaatcaagcgcgtaccctgcgagacaccgcccgagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 42705 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42706 - DNA, 335 bp, Artificial
  Mutation in BnaC.FAD2.b introduced by TALE nuclease pair BnFAD2_T03
caggatccatgggtgcaggtggaagaatgcaagtctctcctccctccaaaaagcctgaaaccgacaccatcaagcgcgtcccctgcgagacaccacccttcactgagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42707 - DNA, 411 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaggtcttgaccccggagcaggtggtggccatcgccagccacgatggcggcaagcaggcgctggagaagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42708 - DNA, 349 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtccgaacgggcctctgggtcatcgcccacgaatgcggccaccacgccttcagcgactac

SEQ ID NO: 42709 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtccactgcgagacaccacccttcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42710 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccaagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42711 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42712 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacctacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42713 - DNA, 350 bp, Artificial
  Mutation in BnaC.FAD2.b introduced by TALE nuclease pair BnFAD2_T03
caggatccatgggtgcaggtggaagaatgcaagtctctcctccctcctgctcccccgaaaccaaaaccctcaaacgcgtcccctgcgagacaccacccttcacttgagacctcaagaaagcaatcccacctcactgcttcaaacgctccatccctcgctccttctcctccctcctcttcgacatcctcgtctcctcctccctctaccacctctccacagcctacttccctctcctccccctccctctcccttacctcgcctggcccctctactgggcctgccaaggctgcgtcctaacgggcctctgggtcatcgcccacgaatgcggccaccacgccttcagcgactac

SEQ ID NO: 42714 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 42715 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactat

SEQ ID NO: 42716 - DNA, 422 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctatctccagcggctgttgccaccgccattgctggcgatggccaccacctgctggggggtcaagccgtgggcctggcacagcaccgggagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42717 - DNA, 352 bp, Artificial
  Mutation in BnaC.FAD2.b introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtcgagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 42718 - DNA, 344 bp, Artificial
  Mutation in BnaC.FAD2.b introduced by TALE nuclease pair BnFAD2_T03
caggatccatgggtgcaggtgaaagaatgcaagtctctcctccctccagctcccccggaaccaacaccctcaaacgcgtcccctgcgagacaccaccattcactcggagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42719 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggagacctcaagaaagcaatcccacctcactgcttcaaacgctccatcccacgctccttctcctcttcgacatcatcatctcctcctcggctcctccctctaccacctctccacagcccacttccctctcccttacctcgcctgacccctctactgggcctgccaaggctgcgtcctaacgggcctctgggtcatagcccacgagtgcggccaccacgccttcagcgactac

SEQ ID NO: 42720 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactgagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 42721 - DNA, 356 bp, Artificial
  Mutation in BnaC.FAD2.b introduced by TALE nuclease pair BnFAD2_T03
caggatccatgggtgcaggtggcagaatgcaagtgtctcctccctccaagaagtctgaaaccgacaccatcaaacgcgtaccctgcgagacaccgcccttcactttgctccaagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttaccgcgcctggcccctctactgggcctgccaaggctgcgtcctaacgggcctctgggtcatcgcccacgaatgcggccaccacgccttcagcgactac

SEQ ID NO: 42722 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactacc

SEQ ID NO: 42723 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgcttcagcgactac

SEQ ID NO: 42724 - DNA, 351 bp, Artificial
  Mutation in BnaC.FAD2.b introduced by TALE nuclease pair BnFAD2_T03
caggatccattggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgtggccaccacgccttcagcgactac

SEQ ID NO: 42725 - DNA, 336 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcatcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42726 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcgtctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42727 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 42728 - DNA, 385 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctcgcttgaccccggagcaggtggtggccatcaccaaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42729 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctcaacctcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42730 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactgaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42731 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctcacgggcctctgggtcatcgcccacgaatgcggccaccacgccttcagcgactac

SEQ ID NO: 42732 - DNA, 356 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42733 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccatgcgagacaccaccattcactctttagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42734 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42735 - DNA, 357 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42736 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 42737 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 42738 - DNA, 440 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctccccccagcaggtggtggccatcgccagcaatggcggtggcaagcaggcgctggagacggtccagcggctgttgccggtgccgtgccaggagacctcaggaaagcaaacccaccccactgcttcaaacgctccatccctcgctccttctcctacctcctcttcgacatcctcgtctcctcctccctcaaccacctctccacagcctacttccctctcctcccccaccctctcccttacctcgcctggcccctctactgggcctgccaaggctgcgtgctaacgggcctcggggtcatcgcccacgaatgcggccaccacgccttcagcgactgc

SEQ ID NO: 42739 - DNA, 348 bp, Artificial
  Mutation in BnaC.FAD2.b introduced by TALE nuclease pair BnFAD2_T03
caggtccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42740 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42741 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactaccggaaaacagcaaaaacccctcactcctcaaaacttcacatccctcacccctcctcctacctcctcttcgacatcatcatctcctcctccctctaccacctctccaccgcctacttccctctcctcccccaccctctcccttacctcgcctggcccctctactgggcctgccaaggctgcgtcctaaccggcgtctgggtcatagcccacgaatgcggccaccacgccttcagcgactac

SEQ ID NO: 42742 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgcccaggctgcgtcctaacgggcctctgggtcatagcccacgagtgcggccaccacgccttcagcgactac

SEQ ID NO: 42743 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtccctgcgagacaccaccattcactcgagacctcaagaaagcaatcccacctcactgcttcaaacgctctatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42744 - DNA, 411 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacggtccagcggctgttgccggtgctgtgccaggcccacggcttgacccctcagcaggtggtggccatcgccagcaatggcggcggcaggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42745 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 42746 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctggttcatagcccacgagtgcggccaccacgcctgcagcgactac

SEQ ID NO: 42747 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcaggactac

SEQ ID NO: 42748 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 42749 - DNA, 403 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcggatggcgggcatcaaactaagcagaaggccatctgcttagtttgacgcccgccagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42750 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccaccctccttctcctcttcgacatcatcatctcctcctcggctcctccctctcccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 42751 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42752 - DNA, 329 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaaacgcgtcccctgttatcgagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42753 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42754 - DNA, 335 bp, Artificial
  Mutation in BnaC.FAD2.b introduced by TALE nuclease pair BnFAD2_T03
caggatccatgggtgcaggtggaagaatgcaagtctctcctcactccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctggggcatagcccacgagtgcggccaccacgccttcagcgactac

SEQ ID NO: 42755 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgtctggcccctctactgggcctgccaaggctgcgtcctaacgggcctctgggtcatcgcccacgaatgcggccaccacgccttcagcgactac

SEQ ID NO: 42756 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggcttcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcggggtcatcgcccacgaatgcggccaccacgccttcagcgactac

SEQ ID NO: 42757 - DNA, 335 bp, Artificial
  Mutation in BnaC.FAD2.b introduced by TALE nuclease pair BnFAD2_T03
caggatccatgggtgcaggtgcaagaatgcaagtgtctcctccctccaagaagtctgaaaccgacaccatcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctggtgcatcgcccacgaatgcggccaccacgcctgcagcgactac

SEQ ID NO: 42758 - DNA, 343 bp, Artificial
  Mutation in BnaC.FAD2.b introduced by TALE nuclease pair BnFAD2_T03
caggatccatgggtgcaggtggaagaatccaagtatctcctcccttcaagaagtctgaaaccgacaccctcaagcgcgtaccctgcgagacaccgcccttcaactcaagaaagcaatcccaccgcactgtttcaaacgctcgatccctcgctccttctcctacctcctcttcgacatcctcgtctcctcctccctctaccacctctccacagcctacttccctctcctccctcagcctctcccttacctcgcctggcccctctactgggcctgccaaggctgcgtcctaacgggcctctggttcatagcgcacgaggtcggccaccacgccttcagcgactac

SEQ ID NO: 42759 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccactacgccttcagcgactac

SEQ ID NO: 42760 - DNA, 370 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcggggtcaagccgtgggcctggcacagcaccggcaacaggagacctcaagaaagcaatcccacctcactgcttcaaacgctccatcccacgctccttctcctcttcgacatcatcatctcctcctcggctcctccctctaccacctctccacagcctacttccctctcccttaccttgcctgacccctctactgggcctgccaaggctgcgtcctaacgggcctctgggtcatagcccacgagtgcggccaccacgccttcagcgactac

SEQ ID NO: 42761 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgtgcctctgggtcatagcccacgagggcggccaccacgccttcagcgactac

SEQ ID NO: 42762 - DNA, 349 bp, Artificial
  Mutation in BnaC.FAD2.b introduced by TALE nuclease pair BnFAD2_T03
caggatccatgggtgcaggtgacagaatgcaagtctctcctccctccagctcccccgaaaccaaaaccctcaaacgcgtcccctgcgagccaccacccttcactcagacctcaagaaagcaatcccacctcactgcttcaaacgctccatccctcgctccttctcctacctcctcttcgacatcctcgtctcctcctccctctaccacctctccccagcctacttccctctcctcccccaccctctcccttaccgcgcctgacccctctactgggcctgccaaggctgcgtcctaacgggcctcgggggcatagctcacgagtgcggccaccacgccttcagcgactac

SEQ ID NO: 42763 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 42764 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtaactcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgacgac

SEQ ID NO: 42765 - DNA, 331 bp, Artificial
  Mutation in BnaC.FAD2.b introduced by TALE nuclease pair BnFAD2_T03
caggatccatgggtgcaggtggaagaatgcaagtctctcctccctctagctcccccggaaccaacaccctcaaacgcgtcccctgcgagacaccaccattcacacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 42766 - DNA, 331 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcacacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaaggctgcgtcctaacgtgcctctggttcatagcccacgagtgcggccaccacgcctgcagcgactac

SEQ ID NO: 42767 - DNA, 319 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42768 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaagactgcgtcctaacgggcctctgggtcatagcccacgagtgcggccaccacgccttcagcgactac

SEQ ID NO: 42769 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctatccggcgtctgggtcatagcccacgagtgcggccaccacgccttcagcgactac

SEQ ID NO: 42770 - DNA, 349 bp, Artificial
  Mutation in BnaC.FAD2.b introduced by TALE nuclease pair BnFAD2_T03
caggatccatgggtgcaggtggaagaattcaagtgtctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgcgcctggcccctctactgggcctgccaaggctgcgtcctaacgggcctctgggtcatcgcccacgaatgcggccaccacgccttcagcgactac

SEQ ID NO: 42771 - DNA, 395 bp, Artificial
  Mutation in BnaC.FAD2.b introduced by TALE nuclease pair BnFAD2_T03
caggatccatgggtgcaggtggaagaatgcaagtctctcctccctccagctccccctgaaccaacaccctcaaacgcgtcccctgcgagacaccaccattcactctcggctgttgccggtgctgtgccaggcccacggcttgaccccggagcaggtggtggccatcgccagccacgatggcggcaagagacctcaagaaagcaatcccacctcactgcttcaaacgctccatcccacgctccttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcagcgactac

SEQ ID NO: 42772 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgcccctgccccctctcctgggcccgccaaggctgcgtcctaacgggcctctggggcatagcccacgagtgcggccaccacgccttcagcgactac

SEQ ID NO: 42773 - DNA, 347 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 42774 - DNA, 273 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacctcactgcttcaaacgctccatcccacgctccttctcctcttcgacatcatcatctcctcctcggctcctccctctaccacctctccacagcctacttccctctcccttacctcgcctgacccctctactgggcctgtcaaggctgcgtcctaacgggcctctgggtcatagcccacgagtgcggccaccacgccttcagcgctac

SEQ ID NO: 42775 - DNA, 333 bp, Artificial
  Mutation in BnaC.FAD2.b introduced by TALE nuclease pair BnFAD2_T03
caggatccatgggtgcaggtggaagaatgcaagtctctcctccctccagctccccctaaaccaaaaccctcaaacgcgtcccctgcgagacaccgcccttcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 42776 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcttcactgcttcaaacgctccatcccacgctccttctcctcttcgacatcatcatctcctcctcgcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42777 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcgagacctcaagaaagcaatcccacctcactgcttcaaacgctccatcccaccctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 42778 - DNA, 409 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccccctggcttgaccccggagcaggtggtggccatcgccagccacgatggcggcaacagccgctggaccgagacctcaagaaagcaatcccacctcactgcttcaaacgctccatccctcgctccttctcctacctcctcttcgacatcctcgtctcctcccccctctcccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42779 - DNA, 382 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgagcgccatctcgaaccgacgttgctggccgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgtcaaggctgcgtcctaacgggcctctgggtcatagcccacgagtgcggccaccacgccttcagcgactac

SEQ ID NO: 42780 - DNA, 418 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagatcggcgatatcgatgctgtccatgtgctgtctctcgaacttggcagcggcagtctccttatcggagacctcaagaaagcaatcccacctcactgcttcaaacgctccatcccacgctccttctcctcttcgacaccatcatctcctcctcggctcctccctctaccacctctccccagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42781 - DNA, 282 bp, Artificial
  Mutation in BnaC.FAD2.b introduced by TALE nuclease pair BnFAD2_T03
caggatccatgggtgcaggtggaagaatgcaagtctctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccactaatgcggccaccacgccttcagcgactac

SEQ ID NO: 42782 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42783 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagggcggccaccacgccttcagcgactac

SEQ ID NO: 42784 - DNA, 372 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggtttcccgactggaaagcggagacctcaagaaagcaatcccacctcactgcttcaaacgctccatccctcgctccttctcctacctcctcttcgacatcctcgtctcctcctccctctaccacctctccacagcctacttccatctcctcccccaccctctcccttacctcgcctggcccctctactgggcctgccaaggctgcgtcctaacgggcctctgggtcatcgcccacgaatgcggccaccacgccttcagcgactac

SEQ ID NO: 42785 - DNA, 349 bp, Artificial
  Mutation in BnaC.FAD2.b introduced by TALE nuclease pair BnFAD2_T03
catgatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42786 - DNA, 334 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42787 - DNA, 290 bp, Artificial
  Mutation in BnaC.FAD2.b introduced by TALE nuclease pair BnFAD2_T03
caggatccatgggtgcaggtggcagaatgcaagtctctcccctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggccccgctactgggcgtgccaaggctgcgtcctaacgggcctctgggtcgtcgcccaccaatgcggtcacctcgccttcagcgactac

SEQ ID NO: 42788 - DNA, 453 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgtccagcggctgttgccggtgctgtgccaggcccacggcttgaccccggagcaggtggtggccatcgccagcaatattggtggcaagcaggcgctggcacaaagacctcaagaaagcaatcccacctcactgcttcaaacgctccatcccacgctccttctcctcccccctctccgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42789 - DNA, 336 bp, Artificial
  Mutation in BnaC.FAD2.b introduced by TALE nuclease pair BnFAD2_T03
caggatccatgggtgcaggtggaagaatacaagtctctcctcccaccagctcccccgaaaccaaaaccctcaaacgcgtcccctgcgagacaccacccttcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42790 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 42791 - DNA, 475 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctgcctggcacagcaccggcaacagccgctggaccgtctccagcgcctgcttgccgccatcgtggctggcgatggccaccacctgctccggggtcaagccgtgggcctggcacagcaccggcaacaggcgctggtactcagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42792 - DNA, 368 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgagcgccatctcgaaccgacgttgctggccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42793 - DNA, 336 bp, Artificial
  Mutation in BnaC.FAD2.b introduced by TALE nuclease pair BnFAD2_T03
caggatccatgggtgcaggtggaagaatgcaagtctctcctgactccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42794 - DNA, 324 bp, Artificial
  Mutation in BnaC.FAD2.b introduced by TALE nuclease pair BnFAD2_T03
caggatccatgggtgcaggtggaagaatccaagtctctcctccctccagctcccccggaaccaacaccctcaaacgcgtcccctgcgagacaccaccattcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42795 - DNA, 404 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgctggcgatggccaccacctgctggggggtcaagccgtgggcctggcacagcaccggcaacagccgctggacccacctcactgcttcaaacgctccatccctcgctccttctcctacctcctcttcgacatcctcgtctcctcctccctctaccccctctccacagcctacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 42796 - DNA, 335 bp, Artificial
  Mutation in BnaC.FAD2.b introduced by TALE nuclease pair BnFAD2_T03
caggatccatgggtgcaggtggaagaatgtaagtctctcctccctccagctcccccgaaaccaaaaccctcaaacgcgtcccctgcgagacaccgcccttcactcgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42797 - DNA, 337 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccattcactgtaagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42798 - DNA, 312 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctcaccctctctcctacttcgcctgacccctctactgggcctgccaaggctgcgtcctaacgggcctctgggtcatagcccacgagtgcggccaccacgccttcagcgactac

SEQ ID NO: 42799 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctcgcccttaccgcgcctggcccctctactgggcctgccaaggctgcggcctaacgggcctctgggtcatcgcccacgaatgcggccaccacgccttcagcgactac

SEQ ID NO: 42800 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 42801 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgacctcaagaaagcaatcccacctcactgcttcaaacgctccatcccacgctccttctcctcttcgccatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 42802 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcagacctcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42803 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42804 - DNA, 348 bp, Artificial
  Mutation in BnaC.FAD2.b introduced by TALE nuclease pair BnFAD2_T03
cggatccatgggtgcaggtggaagaatgcaagtctcccctccctccagctcccccgggaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctcacgggcctctgggtcatcgcccacgaatgcggccaccacgccttcagcgactac

SEQ ID NO: 42805 - DNA, 336 bp, Artificial
  Mutation in BnaC.FAD2.b introduced by TALE nuclease pair BnFAD2_T03
caggatccatgggtgcaggtagaagaatgcaagtctctcctccctccagctcccccgaaaccaaaaccctcaaacgcgtcccctgcgagacaccacccttcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctggttcatagcccacgagtgcggccaccacgccttctgcgactac

SEQ ID NO: 42806 - DNA, 409 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttgcactgacgggtgccccgctcaacttgaccccccagcaggtggtggccatcgccagcaataatggtggcaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 42807 - DNA, 341 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactctacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42808 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcctttctttctggagacctcaagaaagcaatcccacctcactgcttcacacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 42809 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggcttcgtcctaacgggcctctgggtcatagcccacgagtgcggccaccacgccttcagcgactac

SEQ ID NO: 42810 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42811 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccaccgcactgtttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 42812 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 42813 - DNA, 343 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacaccaccattcactcgagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggcggtgtcctaacgggcctctgggtcatcgcccacgaatgcggccaccacgccttcagcgactac

SEQ ID NO: 42814 - DNA, 350 bp, Artificial
  Mutation in BnaC.FAD2.b introduced by TALE nuclease pair BnFAD2_T03
caggatccatgggtgcaggtggaagaatgcaagtctctcctccctcccgctcccccgaaaccaaaaccctcaaacgcgtcccctgcgagacaccacccttcactctagacctaaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42815 - DNA, 335 bp, Artificial
  Mutation in BnaC.FAD2.b introduced by TALE nuclease pair BnFAD2_T03
caggatccatgggtgcaggtggcagaatgcaagtctctcctccctccagctcccccggaaccaacaccctcaaacgcgtcccctgcgagacaccacccttcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42816 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagggcggccaccacgccttcagcgactac

SEQ ID NO: 42817 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaccctcaaacgcgtcccctgcgagacaccacccttcactagaacttaagaaagcaatcccacctcactgcttcaaacgctccatccctcggtccttctcctccctcctcttcgacatcctcgtctcctcctccctctaccacctccccacagcctacttccctctcccttaccccgcctgacccctctactgggcctgccaaggctgcgtcctaacgggcctctgggtcatagcccacgagtgcggccaccacgccttcagcgactac

SEQ ID NO: 42818 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 42819 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccgacaccatcaaacgcgtcccctgcgagacaccacccttcactctcaagaaagcaatcccacctcactgcttcaaacgctccatcccacgctccttctcctcttcgacatcatcatctcctcctcggctccaccctctaccacctctccacagcctacttccctctctcctacttcgcctggcctctctactgggcctgccaagggtgcgtcctaaccggcgtctgggtcatagcccacgagtgcggccaccacgccttcagcgactac

SEQ ID NO: 42820 - DNA, 315 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42821 - DNA, 265 bp, Artificial
  Mutation in BnaC.FAD2.b introduced by TALE nuclease pair BnFAD2_T03
caggatccatgggtgcaggtggaagaatgcaagtctctcctccctccagtctctccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 42822 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42823 - DNA, 347 bp, Artificial
  Mutation in BnaC.FAD2.b introduced by TALE nuclease pair BnFAD2_T03
caggatccatgggtgcaggtggcagaatgcaagtctctactccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42824 - DNA, 442 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagagattttgagacacgggccagagctgccaggaaacagctatgaccatgtaatacgactcactataggggatgggatccgatgaagacaatcgacagagacctcaagaaagcaatcccacctcactgcttcaaacgctccatccctcgctccttctcctaccgcctcttcgacctcctcgtctcctcctcggctcctccctctaccacctctccacagcctacttccctctcccttacctcgcctggcctctctactgggcctgccaaggctgcgtcctaaccggcgtctgggtcatagcccacgagtgcggccaccacgccttcagcgactac

SEQ ID NO: 42825 - DNA, 332 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 42826 - DNA, 329 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccatggcggacctcaagaaagcaatcccaccttactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42827 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42828 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaaccggcgtcggggtcatagcccacgagtgcggccaccacgccttcagcgactac

SEQ ID NO: 42829 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttgagacctcaagaaagcaatcccacctcactgcttcaaacgctccatccctcgctccttctcctacctcctcttcgacatcctcgtctcctcctccctctaccacctctccacagcctacttccctctcctcccccaccatctcccttacctcgcctggcccctctactgggcctgccaaggctgcgtcctaacgggcctctgggtcatcgcccacgaatgcggccaccacgccttcagcgactac

SEQ ID NO: 42830 - DNA, 337 bp, Artificial
  Mutation in BnaC.FAD2.b introduced by TALE nuclease pair BnFAD2_T03
caggatccatgggtgcaggtggaagaatgcaagtgtctcctccctccaacacgtctgaaaccgacaccatcaagcgcgtaccctgcgagacaccgcccttcactgtgagaactcaagaaagcaatcccaccgcactgtttcacacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42831 - DNA, 342 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttagaactcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42832 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 42833 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcacgagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 42834 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcacctcaagaaagcaatcccacctcactgcttcaaacgctccatccctcgctccttctcctcttcgacatcatcatctcctcctcggctcctccctctaccacctctccacagccttcttccctctcccttacctcccctgacccctctactgggcctgccaaggctgcgtcctaacgggcctcggggtcatagcccacgagtgcggccaccacgccttcagcgactac

SEQ ID NO: 42835 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42836 - DNA, 402 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggtcaagccgtgggcctggcacagcaccggcaagcaggcgctggagacgagaactcaagaaagcaatcccacctcactgcttcaaacgctccatccctcgctccttctcctacctcctcttcgacatcctcgtctcctcctccctctaccacctctccccggcctacttccctctcctccccccccctctcccttccctcgcctggcccctctactgggcctgccaaggctgcgtcctaacgggcctctgggtcatcgcccacgaatgcggccaccacgccttcagcgactac

SEQ ID NO: 42837 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaactaaaaccctcaaacgcgtcccctgcgagacaccatgacagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42838 - DNA, 335 bp, Artificial
  Mutation in BnaC.FAD2.b introduced by TALE nuclease pair BnFAD2_T03
caggatccatgggtgcaggtggaagaatgcaagtgtatcctccctccaagaagtctgaaaccgacaccatcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42839 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 42840 - DNA, 317 bp, Artificial
  Mutation in BnaC.FAD2.b introduced by TALE nuclease pair BnFAD2_T03
caggatccatgggtgcaggtggaagaatccaagtctctcctccctccagctcccccggaaccaacaccctcaaacgcgtcccctgccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42841 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaactggcctctgggtcatcgcccacgaatgcggccaccacgccttcagcgactac

SEQ ID NO: 42842 - DNA, 456 bp, Artificial
  Mutation in BnaC.FAD2.b introduced by TALE nuclease pair BnFAD2_T03
caggatccatgggtgcaggtgcaagaatgcaagtctctcctccctccagctcccccggaaccaacaccctcaaacgcgtcccctgcgagacaccaccattcactctcgggcaggtggtggccatcgccagcaatattggtggcaagcaggcgctggagacggtgcaggcgctgttgccggtgctgtgccaggcccacggcttgaccccggagcaggtggctggcggagacctcaagaaagcaatcccacctcactgcttcaaacgctccatcccaccctccttcccctcttcgccatcatcacctcctcctcggctcctccctctaccacctctccacagcctacttccctctcccttacctcgcctaacccctctactgggcctgccaaggctgcgtcctaacggtcctctggggcatagcccacaagtgcggccaccacgcctgcagcgactac

SEQ ID NO: 42843 - DNA, 324 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactaaagcaatcctacctcacttcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 42844 - DNA, 328 bp, Artificial
  Mutation in BnaC.FAD2.b introduced by TALE nuclease pair BnFAD2_T03
caggatccatgggggcaggtggaagaatgcaagtctctactccctccagctcccccggaaccaacaccctcaaacgcgtcccctgcgagacaccaccattcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagcgtgcgtcctacccggcgtctgggtcatagcccacgagtgcggccaccacgccttcagcgactac

SEQ ID NO: 42845 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctacggggcctgccaagcctgcgtcctaacgggcctctgggtcatagcccacgagtgcggccaccacgccttcagcgactac

SEQ ID NO: 42846 - DNA, 349 bp, Artificial
  Mutation in BnaC.FAD2.b introduced by TALE nuclease pair BnFAD2_T03
caggatccatgggtgcaggtggaagaatgcaagtctttactccctcaagctcccccgaaaccaaaaccctcaaacgcgtcccctgtgagataccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccccgcctggcccctctactgggcctgccaaggctgcgtcctaacgggcctctggtcatagcccacgagtgcggccaccacgccttcagcgactac

SEQ ID NO: 42847 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccagagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 42848 - DNA, 335 bp, Artificial
  Mutation in BnaC.FAD2.b introduced by TALE nuclease pair BnFAD2_T03
caggatccatgggtgcaggtggcagaatgcaagtctctcctccctccagctcccccgaaaccaaaaccctcaaacgcgtcccctgcgagacacacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaacgggcctctgggtcatcgcccacgaatgcggccaccacgccttcagcgactac

SEQ ID NO: 42849 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcggggtcatagcccacgagggcggccaccacgccttcagcgactac

SEQ ID NO: 42850 - DNA, 335 bp, Artificial
  Mutation in BnaC.FAD2.b introduced by TALE nuclease pair BnFAD2_T03
caggatccatgggtgcaggtggaagaatgcaagtctctcctccctccacctcccccggacccacccccctcaaacccttcccctgcgagacaccaccattcacccagacctcaagaaagcaatcccccctcactgcttcaacccctccatcccacccgccttctcctcttcgacatcatcatctcctcctcggctcctccctctcccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 42851 - DNA, 329 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgccctagacctcaagaaagcaatcccacctcactgcttcaaacgctccatcccacgctccttctcctcttcgacatcatcatctcctcctcggctcctccctctaccacctctccacagcctacttccctctccctaacctcgcctgacccctctactgggcctgccaaggctgcgtcctaacgggcctctgggtcatagcccacgagtgcggccaccacgccttcagcgactac

SEQ ID NO: 42852 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42853 - DNA, 404 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcttgctggcgatggccaccacctgctggggggtcaagccgtgggcctggcacagcaccggcaccggccgctggacccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggcggcgtcctaacgggcctctgggtcatcacccacgaatgcggccaccacgccttcagcgactac

SEQ ID NO: 42854 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttccctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcccctctactgggcctgccaagggtgcgtcctaaccggcgtctgggtcatagcccacgagtgcggccaccacgccttcagcgactac

SEQ ID NO: 42855 - DNA, 351 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctccctgacctcgcctggcccctctactgggcctgccaaggctgcgtcctaacgggcctcggggtcatcgcccacgaatgcggccaccacgccttcagcgactac

SEQ ID NO: 42856 - DNA, 280 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccacctcactgcttcaaacgctccatccctcgctccttctcctacctcctcttcgacatcctcgtctcctcctccctctaccacctctccacagcctacttccctctcccttacctcgcctgacccctctactgggcctgccaaggcttcgtcctaacgggcctctgggtcatagcccacgagtgcggccaccacgccttcagtgactac

SEQ ID NO: 42857 - DNA, 347 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaacaccctcaaacgcgtcccctgcgagacaccaccattcactcacctcaagaaagcaatcccaccgcactgtttcaaacgctccatccctcgctctttctcctacctcatcttcgacatcgtcatagcctcctccttctaccacttccccaccgcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 42858 - DNA, 329 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccagagacctcaagaaagcgatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42859 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42860 - DNA, 338 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcatgaaagcaatcccaccgcactgtttcaaacgctcgatccctcgctctttctcctacctcatctgggacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42861 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42862 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42863 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 42864 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 42865 - DNA, 264 bp, Artificial
  Mutation in BnaC.FAD2.b introduced by TALE nuclease pair BnFAD2_T03
cagatccatgggtgcaggtggaagaatgcaagtctctcctccctccagtctctccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42866 - DNA, 321 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagcgagacctcaagaaagcaatcccacctcactgcttcaaacgctccatcccacgctccttctcctcttcgacatcatcatctcctcctcggctcctccctctaccacctctccacaccctacttccctctcccttacctcgcctgacccctctactgggcctgccaaggctgcgtcctaacgggcctctgggtcatagcccacgagtgcggccaccacgccttcagcgactac

SEQ ID NO: 42867 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgcagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42868 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagcggctgttgccggtgctgtgccaggcccccgctcaatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42869 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaaggcggccaccacgccttcagcgactac

SEQ ID NO: 42870 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacgccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42871 - DNA, 383 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtaacgaccttttggaaacttcggcttcccctgaaagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42872 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccatctcctcccccaccctctcccttacctcgcctggcccctctactgggcctgccaaggctgcgtccgaacgggcctctgggtcatagcccacgagtgcggccaccacgccttcagcgactac

SEQ ID NO: 42873 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgcgcctggcccctctacggggcctgccaaggctgcgtcctaacgggcctctgggtcatcgcccacgaatgcggccaccacgccttcagcgactac

SEQ ID NO: 42874 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagggcggccaccacgccttcagcgactac

SEQ ID NO: 42875 - DNA, 317 bp, Artificial
  Mutation in BnaC.FAD2.b introduced by TALE nuclease pair BnFAD2_T03
caggatccatgggtgcaggtgaaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcggcctaacgggccgctgggtcatagcccacgagtgcggccaccacgcctggagcgactac

SEQ ID NO: 42876 - DNA, 296 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 42877 - DNA, 412 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgccagccacgatggcggcaagcaggcgctggagacggtccagcggctgttgccggtgctgagacctcaagaaagcaatcccacctcactgcttcaaacgctccatcccaccctccttctcctcttcgacatcatcatctcctccccggctcctccctctaccacctccccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42878 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccagggctgcgtcctaaccggcgtctgggtcatcgcccacgaatgcggccaccacgccttcagcgactac

SEQ ID NO: 42879 - DNA, 343 bp, Artificial
  Mutation in BnaC.FAD2.b introduced by TALE nuclease pair BnFAD2_T03
caggatccatgggtgcaggtggaagaatgcaagtgtctcctccctccaaaaagtatgaaaccgacaccatcaagcgcgtaccctgcgagacaccgccattcactctcggtcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42880 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 42881 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42882 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttcctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42883 - DNA, 400 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcttgaccccccagcaggtggtggccatcgccagccacgatggcggcaacagccgctggaccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 42884 - DNA, 425 bp, Artificial
  Mutation in BnaC.FAD2.b introduced by TALE nuclease pair BnFAD2_T03
caggatccatggtgcaggtggaagaatgcaagtctctcctccctacagctcccccggaaccaacaccctcaaacgcgtcccctgcgagacaccaccattcactctcggggagaaaggcggacaggtatccggtaagcggcagggtcggaacagccgctggaccgtctccagcgcctgcttgccaccattattgctggccctcaagaaagcaatcccacctcactgcttcaaacgctccatcccacgctccttctcctcttcgacatcatcatctcctcctcggctcctccctctcccacctctccacagcctacttccctctcccttccctcgcctgacccctctaccgggcctgccaaggctgcgtcctaacgggcctctgggtcatagcccactagtgcggccaccacgccttcagcgactac

SEQ ID NO: 42885 - DNA, 279 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttcgacatcctcgtttcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42886 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgtggccatcgccagcaatggcggtggcaagcaggcgctggagacggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42887 - DNA, 381 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggagagcgttcaccgacaaacaacagataaaacgaaaggcccagtcacctcaagaaagcaatcccacctcactgcttcaaacgctccatcccacgctccttctcctcttcgacatcatcatctcctcctcggctcctccctctgccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 42888 - DNA, 341 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccaccagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42889 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42890 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccccctcccttacctcgcctggcccctctactgggcctgccaaggctgcgtcctaacgggcctctgggtcatcgcccacgaatgcggccaccacgcctttcagcgactac

SEQ ID NO: 42891 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42892 - DNA, 342 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttccctcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42893 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaatgcgtcccctgcgagacaccacccttcactctagacctcaagaaagcaatcccacctcactgcttcaaacgctccatcccacgctccttctcctcttcgacatcatcatctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 42894 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgagtcccctgcgagacaccatcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccatcagcgactac

SEQ ID NO: 42895 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttgacctcaagaaagcaatcccacctcactgcttcaaacgctccatccctcgctccttctcctacctcctcttcgacatcctcgtctcctcctccctctacaacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42896 - DNA, 257 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcctcggctcctccctctaccacctctccacagcctacttccctctcccttacctcgcctgacccctctactgggcctgccaaggctgcgtcctaaccggcctctgggtcatagcccacgagtgcggccaccacgccttcagcgactac

SEQ ID NO: 42897 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 42898 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcatcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42899 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccaccactccacagcctacttccctctcccttacctcgcctgacccctctactgggcctgccaaggctgcgtcctaacgggcctctgggtcatcgcccacgaatgcggccaccacgccttcagcgactac

SEQ ID NO: 42900 - DNA, 315 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttaagacctcaagaaagcaatcccacctcactgcttcaaacgctccatccctcgctccttctcctacctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42901 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatcccacgctccttctcctcttcgacatcatcatctactcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 42902 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctaaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42903 - DNA, 370 bp, Artificial
  Mutation in BnaC.FAD2.b introduced by TALE nuclease pair BnFAD2_T03
cagggatccatgggtgcaggtggaagaatgcaagtctctcctccctccagctcccccggaaccaacaccctcaaacgcgtcccctgcgaggcccacggcttgaccccggagcaggtggtggccatcgccagccacgatggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgtgtcatagcccacgagtgcggccaccacgccttcagcgactac

SEQ ID NO: 42904 - DNA, 348 bp, Artificial
  Mutation in BnaC.FAD2.b introduced by TALE nuclease pair BnFAD2_T03
caggatccatgggtgcaggtggaagaatgcaagtctcccctccctccagctcccccggaaccaacaccctcaaacgcgtcccctgcgagccaccaccattcactcaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctggttcatcgcccacgaatgcggccaccacgccttctgcgactac

SEQ ID NO: 42905 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcatggcccctctactgggcctgccaaggctgcgtcctaacgggcctctgggtcatcgcccacgaatgcggccaccacgccttcagcgactac

SEQ ID NO: 42906 - DNA, 331 bp, Artificial
  Mutation in BnaC.FAD2.b introduced by TALE nuclease pair BnFAD2_T03
caggatccatgggtgcaggtggaagaatgcaagtatctcctccctccagctcccccgaaaccaaaaccatcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccagggctgcgtcctaaccgtcgtctgggtcatagcccacgagttcggccaccacgccttcagcgactac

SEQ ID NO: 42907 - DNA, 309 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaactggcctctgggtcatagcccacgagtgcggccaccacgccttcagcgactac

SEQ ID NO: 42908 - DNA, 392 bp, Artificial
  Mutation in BnaC.FAD2.b introduced by TALE nuclease pair BnFAD2_T03
caggatccatgggtgcgggtggaagaatgcaagtctctcctccctccaagaagtctgaaaccgacaccatcaagcgcgtaccctgcgagacaccgcccttcactgtcgtaatctggaacatcgtatgggtaatcgatgaccttacgtttaaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 42909 - DNA, 418 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagatcggcgatatcgatgctgtccatgtgctgtctctcgaacttggcagcggcagtctccttatcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaagggtgcgtcctaacgggcctctgggtcatcgcccacgaatgcggccaccacgccttcagcgactac

SEQ ID NO: 42910 - DNA, 400 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctggctacgctgcgatcatgtcctgatacttgacagcgacggtccctatcgcagacctcaagaaagcaatcccacctcactgcttcaaacgctccatccctcgctccttctcctacctcctcttcgacatcctcgtctcctcctccctctaccacctctccacagcctacttccctctcctcccccaccccctcccttacctcgcctggcccctctactgggcctgccaaggctgcgtcctaacgggcctctgggtcatcgcccacgaatgcggccaccacgccttcagcgactac

SEQ ID NO: 42911 - DNA, 316 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagaactcaagaaagcaatcccaccgcactgtttcaaacgctccatccctcgctccttctcctacctcctcttcgacatcctcgtctcctcctccctctaccacctctccacagcctacttccctctactcccccaccctctcccttacctcgcctggcctctctactgggcctgccaagggtgcgtcctaaccggcgtctgggtcatagcccacgagtgcggccaccacgccttcagcgactac

SEQ ID NO: 42912 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42913 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcgtctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 42914 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagaactcaagaaagcaatcccacctcactgcttcaaacgctccatccctcgctccttctcctacctcctcttcgacatcctcgtctcctcctccctctactacctcgccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42915 - DNA, 375 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcttcaagtatgacgggctgatactgggccggcaggcgctccaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42916 - DNA, 334 bp, Artificial
  Mutation in BnaC.FAD2.b introduced by TALE nuclease pair BnFAD2_T03
caggatcctgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42917 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgacta

SEQ ID NO: 42918 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 42919 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccaccctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42920 - DNA, 347 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactcccctcaagaaagcaatcccacctcactgcttctaactctccctccctctctccttctcctacctcctcttcgacatcctcgtctcctcctccctctccctcctctccccagcctccttcccccccctccccccccccctcccttacctcgcctggcccctctactgggcctgccaaggctgcgtcctaacgggcctctgggtcatagcccacgagtgcggccaccacgccttcagcgactac

SEQ ID NO: 42921 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccatccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42922 - DNA, 332 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcggagacctcaagaaagcaatcccacctcactgcttcaaacgctccatccctcgctccttctcctacctcctcttcgacatcctcgtctcctcctccctctaccacctctccacagcctacttccctctcccttgcctcgcctgacccctctactgggcctgccaaggctgcgtcctaacgggcctctgggtcatagcccacgagtgcggccaccacgccttcagcgactac

SEQ ID NO: 42923 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42924 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatcccacgccccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42925 - DNA, 311 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42926 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccaccattcactctacctcaagaaagcaatcccacctcactgcatcaaacgctccatcccacgctccttctcctacctccccttcgccatcctcgactcctcctccctctaccacctctccacagcctacttccctctcccttacctcgcctggcccctctactgggcctgccagggctgcgtcctaacgggcctctgggtcatagcccacgagtgcggccaccacgccttcagcgactac

SEQ ID NO: 42927 - DNA, 335 bp, Artificial
  Mutation in BnaC.FAD2.b introduced by TALE nuclease pair BnFAD2_T03
caggatccatgggtgcaggtgcaagaatgcaagtctctcctccctccagctcccccgaaaccaaaaccctcaaacgcgtcccctgcgagacaccaccattcactcagacctcaagaaagcaatcccacctcactgcttcaaatgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42928 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgacac

SEQ ID NO: 42929 - DNA, 363 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcggcgggtgtggtggttacgcgcaaagacctcaagaaagcaatcccacctcactgcttcaaacgctccatcccacgctccttctcctcttcgacatcatcatcccctcctcggctcctccctctaccacctctccacaccctacttccctctcccttacctcgcctgacccctctactgggcctgccaaggctgcgtcctaacgggcctctgggtcatagcccacgagtgcggccaccacgccttcagcgactac

SEQ ID NO: 42930 - DNA, 305 bp, Artificial
  Mutation in BnaC.FAD2.b introduced by TALE nuclease pair BnFAD2_T03
caggatccatgggtgcaggtggaagaatgcaagtctctcctccctccagctaccccggaaccaacaccctcaaacgcgtcccctgcgagacaccaccattcactgcttcaaacgctccatcccacgctccttctcctcttcgacatcatcatctcctcctcggctcctccctctaccacatctccacagcctacttccctctcccttacctcgcctgacccctctactgggcctgccaaggctgcgtcctaacgggcctctgggtcatagcccacgagtgcggccaccacgccttcagcgactac

SEQ ID NO: 42931 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaaggcggccaccactccttcagcgactac

SEQ ID NO: 42932 - DNA, 346 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtcccctgcgagacaccacccttcactctgtagagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42933 - DNA, 382 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccacccttcactctcacctcaagaaagcaatcccacctcactgattcaaacgctccctccctcgctccttctcctacctcctcttcgacatcctcgtctcctcctccctctaccacctctccacagcccacttccctctcctcccccccccccccccttcccccctcccccccccccccccccctcccccctcccccgcccggcccctccacggggcctgcccaggccgcgtcctaacgggcctctgggtcatcgcccacgagtgcggccaccacgccttcagcgactac

SEQ ID NO: 42934 - DNA, 357 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcggcgggtgtggtggttacgtagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42935 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttttggagacctcaagaaagcaatcccacctcactgcttcaaacgctccatcccacgctccttctcctcttcgacatcatcatctcctcctcggctactccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 42936 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccatggcggacctcaagaaagcaatcccacctcactgcttcaaacgctccatccaacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42937 - DNA, 343 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgttcggagaactcaagaaagcaatcccaccgcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccgcgaatgcggccaccacgccttcagcgactac

SEQ ID NO: 42938 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42939 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggtctctgggtcatcgcccacgaatgcggccaccacgccttcagcgactac

SEQ ID NO: 42940 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccgtagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42941 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccagggctgcgtcctaacgggcctctgggtcatagcccacgagtgcggccaccacgccttcagcgactac

SEQ ID NO: 42942 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctataccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42943 - DNA, 405 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagggaaaattaattaatagcgacgatttacagaagcaaggttattcacgatttacagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaatcggcgtctgggtcatagcccacgagtgcggccaccacgccttcagcgactac

SEQ ID NO: 42944 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccctcaagaaagcaatcccacctcactgcttcaaactctccatccctctctccttctcctacctcctcttcgacatcctcgtctcctcctccctctaccacctctccacagcctacttccctctcctcccccaccctctcccttacctcacctggcccctctactggggctgccaaggctgcgtcctaacgggcctcttgggcatagcccacgagtgcggccaccacgccctcagcgactac

SEQ ID NO: 42945 - DNA, 356 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggggagacctcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 42946 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacgacctcaagaaagcaaccccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42947 - DNA, 333 bp, Artificial
  Mutation in BnaC.FAD2.b introduced by TALE nuclease pair BnFAD2_T03
caggatccatggtgcaggtggaagaatgcaagtctctcctccctccagctcccccggaaccaacaccctcaaacgcgtcccctgcgagacaccaccattcactctacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 42948 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 42949 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgccccctgcgagacaccaccagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42950 - DNA, 395 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcggccttctgcttagtttgatgcctggcagtttatggcgggcataagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42951 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccatcagcgactac

SEQ ID NO: 42952 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 42953 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccaggctccttaagaaagcaatcccacctcactgcttcaaacgctccctcccaccctccttctcctcgtcgacaacatcatctcctcctcggctcctccctctaccacctcaccacagcctacttccctctcccttacctcgcctgacccctctactgggccggccaaggctgcgtcctaacgggcctctgggtcatagcccacgagtgcggccaccacgccttcagcgactac

SEQ ID NO: 42954 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42955 - DNA, 299 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcaatcccacctcactgcttcaaacgctccatccctcgctccttctcctacctcctcttctccatcatcatctcctcctcggctcctccctctcccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 42956 - DNA, 348 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaccgaactcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42957 - DNA, 281 bp, Artificial
  Mutation in BnaC.FAD2.b introduced by TALE nuclease pair BnFAD2_T03
caggatccatgggtgcaggtggaagaatgcaagtctctcatccctccaggtagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 42958 - DNA, 370 bp, Artificial
  Mutation in BnaC.FAD2.b introduced by TALE nuclease pair BnFAD2_T03
caggatcctgggtgcaggtggaagaatgcaagtctctcctccctccagctcccccgaaaccaaaaccctcaaacgcgtcccctgcgagacaccacccttcactctcgccggtgctgtgccaggcccagacctcaagaaagcaatcccacctcactgcttcaaacgctccatccctcgctccttctcctacctcctcttcgacatcctcgtctcctcctccctctaccacctctccacagcctacttccctcccctcccccaccctctcccttacctcgcctggcccctctactgggcctgccaaggctgcgtcctaacgggcctctgggtcatagcccacgagtgcggccaccacgccttcagcgactac

SEQ ID NO: 42959 - DNA, 334 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtcccctgcgagacaccacccttcactgtaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42960 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 42961 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatcgcccacgaatgcggccaccacgccatcagcgactac

SEQ ID NO: 42962 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatatcccacgagtgcggccaccacgccttcagcgactac

SEQ ID NO: 42963 - DNA, 348 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaccctcaaacgcgtcccctgcgagacaccaccattcactcttacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 42964 - DNA, 394 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgccggtgctgtgccaggcccacggcttgaccccccagcaggtggtgggaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42965 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 42966 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42967 - DNA, 314 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctcccccaccctctcccttacctcgcctggcccctctactgggcctgccaaggctgcgtcctaacgggcctctgggtcatcgcccacgaatgcggccaccacgccttcagcgactac

SEQ ID NO: 42968 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaacgccccatcccacgctccttctcctcttcgacatcatcatctcctcctcggctcctccctctcccacctctccacagcctacttccctctcccttacctcgcctggcccctctactgggcctgccagggctgcgtcctaacgggcctctgggtcatcgcccacgaatgcggccaccacgccttcagcgactac

SEQ ID NO: 42969 - DNA, 376 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggtggccatcgccagcaatggcgggggcaacagccgcgggagacctcaagaaagcaatcccacctcactgcttcaaacgctccatcccacgctccttctcctcttcgacatcatcatctcctcctcggctcctccctctaccaccacaccccagcctacttcccccgccctcacctcgcctgacccctcaactgggcctgccaaggctgcgtcctaacgggcctctgggtcatagcccacgagtccggacaccacgccttcagcgactac

SEQ ID NO: 42970 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 42971 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcacctcaagaaagcaatcccacctcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42972 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcttcaaacgctccatcccacgctccttctcctcttcgacatcatcatctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 42973 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42974 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagccctcgagtgcggccaccacgccttcagcgactac

SEQ ID NO: 42975 - DNA, 281 bp, Artificial
  Mutation in BnaC.FAD2.b introduced by TALE nuclease pair BnFAD2_T03
caggatccatgggtgcaggtcgaagaatgcaagtctcccctccctccagctcccccggaaccaacacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42976 - DNA, 348 bp, Artificial
  Mutation in BnaC.FAD2.b introduced by TALE nuclease pair BnFAD2_T03
caggatccatgggtgcaggtggaagaatgcaagtctctcctcccttcagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctcgcccttccctcgcctggcccctctacggggcctgccaaggctgcgtcctaacgggcctctgggtcatcgcccgcgagtgcggccaccgcgccatgagcgactgc

SEQ ID NO: 42977 - DNA, 333 bp, Artificial
  Mutation in BnaC.FAD2.b introduced by TALE nuclease pair BnFAD2_T03
caggatccatgggtgcaggtggaagaatgcaagtctctcctccctacagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctggatcatagcccacgagtgcggccaccacgccttcagcgactac

SEQ ID NO: 42978 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 42979 - DNA, 276 bp, Artificial
  Mutation in BnaC.FAD2.b introduced by TALE nuclease pair BnFAD2_T03
caggatccatgggtgcaggtggaagaatgcaagtctctcctctcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 42980 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgcgcctggcccctctactgggcctgccaaggctgcgtcctaacgggcctctgggtcatcgcccacgaatgcggccaccacgccttcagcgactac

SEQ ID NO: 42981 - DNA, 334 bp, Artificial
  Mutation in BnaC.FAD2.b introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactggaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagcctgcgtcctaacgggcctctggttcatagcccacgagtgcggccaccacgccttcagcgactac

SEQ ID NO: 42982 - DNA, 386 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacacgcctgcttgccgccatcgtggctggcgatggccaccacctgctcctggcacagcagagaactcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 42983 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42984 - DNA, 348 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgcgacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 42985 - DNA, 295 bp, Artificial
  Mutation in BnaC.FAD2.b introduced by TALE nuclease pair BnFAD2_T03
caggatccatgggtgcaggtggaagaatgcaagtctctcctccccccagctcccccgaaaccaaaaccctccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 42986 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 42987 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaacgggcctctgggtcatcgcccacgaatgcggccaccacgccttcagcgactac

SEQ ID NO: 42988 - DNA, 472 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaccaccacctgctggggggtcaagccgtgggcctggcacagcaccggcaaacgttggcgtcggcaaacagtggtccggcgcacgcgctctggaggccttgctcacggtggcgggagagttgagagggagacctcaagaaagcaatcccacctcactgcttcaaacgctccatccctcgctccttctcctaccccccctccgacatcctcgtctactcacccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42989 - DNA, 385 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcccacggcttgaccccccagcaggtggtggccatcgccagcaatggagacctcaagaaagcaatcccacctcactgcttcaaacgctccatcccacgctccttctcctcttcgacatcatcatctactcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42990 - DNA, 334 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 42991 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 42992 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttaactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42993 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcatcccacctcactgcttcaaacgctccatccttcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtcggggtcatagcccgcgagtgcggccaccacgccttcagcgactac

SEQ ID NO: 42994 - DNA, 346 bp, Artificial
  Mutation in BnaC.FAD2.b introduced by TALE nuclease pair BnFAD2_T03
caggatccatgggtgcaggtggaagaatgcaagtgactcctccctccagctcccccgaaaccaaaaccctcaaacgcgtcccctgcgagacaccacccttcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42995 - DNA, 410 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcagcggatttgtcctactcaggagagcgttcaccgacaaacaacagataacacgaaaggcccagtcttccctcaagaaagcaatcccacctcactgcttcaaacgctccatccctcgctccttctcctacctcctcttcgacatcctcgtcccctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42996 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagagacctcaagaaagcaatcccacctcactgcttcaaacgctccatcccacgctccttctcctcttcgacatcatcatctcctcctcggctcctcactctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 42997 - DNA, 356 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactagacctcaagaaagcaatcccacctcactgcttcaaacgctccatccctcgctccttctcctacctcatctgggacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42998 - DNA, 410 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcaggggaagccgaagtttccaaaaggtcgttgatcaaagctcgccgcgttgtttcatcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 42999 - DNA, 310 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcccccaccctctcccttacctcgcctggcccctctactgggcctgccaaggctgcgtcctaacgggcctctgggtcatcgcccacgaatgcggccaccacgccttcagcgactac

SEQ ID NO: 43000 - DNA, 443 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcttccagcgcctgcttgccaccattattgctggcgatggccaccacctgctggggggtcaagccgtgggcctggcacagcaccggcaacagccggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43001 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43002 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43003 - DNA, 308 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43004 - DNA, 295 bp, Artificial
  Mutation in BnaC.FAD2.b introduced by TALE nuclease pair BnFAD2_T03
caggatccatgggtgcaggtggaagaatgcaagtctctcatccctccaggtagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccccgaatgcggccaccacgccttcagcgactac

SEQ ID NO: 43005 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgcctttcagcgactac

SEQ ID NO: 43006 - DNA, 336 bp, Artificial
  Mutation in BnaC.FAD2.b introduced by TALE nuclease pair BnFAD2_T03
caggatccatgggtgcaggtggaagaattcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43007 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaactcctccctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43008 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatcccacgctccttctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 43009 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 43010 - DNA, 351 bp, Artificial
  Mutation in BnaC.FAD2.b introduced by TALE nuclease pair BnFAD2_T03
caggatccatgggtgcagggggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgtcagggctgcgtcctaaccggcgtctgggtcatagcccacgagtgcggccaccacgccttcagcgactac

SEQ ID NO: 43011 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccagacctcaagaaagcaatcccacctcactgcttcaaacgctccatcccacgctccttctcctcttcgacatcatcatctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43012 - DNA, 371 bp, Artificial
  Mutation in BnaC.FAD2.b introduced by TALE nuclease pair BnFAD2_T03
caggatccatgagtgcaggtggaagaatgcaagtcactcctccctccagctcccccgaaaccaaaaccctcaaacgcgtcccctgcgagacaccacccttcactctcgccggtgctgtgccaggcccagacctcaagaaagcaatcccacctcactgcttcaaacgctccatccctcgctccttctcctacctcctcttcgacatcctcgtctcctcctccctctaccacctctccacagcctacttccctctcctcccccaccccctcccttacctcgcctggcccctctactgggcctgccaaggctgcgtcctagccgacgtctgggtcatagcccacgagttcggccaccacgccttcagcgactac

SEQ ID NO: 43013 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43014 - DNA, 382 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgggtcaagccgtgggcctggcacagcaccggcaagcaggcgctggagagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43015 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43016 - DNA, 435 bp, Artificial
  Mutation in BnaC.FAD2.b introduced by TALE nuclease pair BnFAD2_T03
caggatccatgggtgcaggtggaagaatgcaagtgtctcctccctcccagaagtctgaaaccgacaccatcaagcgcgtaccctgcgagacaccgcccttcactctcggtgttgtgccaggcccacggcttgaccccggagcaggtggtggccatcgccagccacgatggcggcaacagccgctggacccagacctcaagaaagcaatcccacctcactgcttcaaacgctccatcccacgctccttctcctcttcgacatcatcatctcctcctcggctcctccctctaccacctctccacagcctacttccctcgcctcccccaccctctcccttacctcgcctggcccctctactgggcctgccaaggctgcgtcctaacgggcctctgggtcatagcccacgagtgcggccaccacgccttcagcgactac

SEQ ID NO: 43017 - DNA, 408 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccactcaaatccgctcccggcggatttgtcctactcaggagagcgttcaccgacaaacaacagataaaacgaagacctcaagaaagcaatcccacctcactgcttcaaacgctccatccctcgctccttctcctacctcctcttcgacatcctcgtctcctcctccctctaccacctctccacagcctacttccctctcctcctccaccctctctcctacttcgcctggcctctctactgggcctgccaagggtgcgtcctaaccggcgtctgggtcatagcccacgagtgcggccaccacgccttcagcgactac

SEQ ID NO: 43018 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccacccttcactctagacctcaagaaagcaatcccacctcactgcttcatccgctccttccctcgctccttctcctccctcctcttcgacatcctcgtctcctcctccctctaccacttctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43019 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacaagaaagcaatcccacctcactgcttcaaacgctccatcccacgctccttctcctcttcgacatcatcatctcctcctcggctcctccctctaccacctctccacagcctacttccctctccattacctcgcctgacccctctactgggcctgccaaggctgcgtcctaacgggcctctgggtcatagcccacgagtgcggccaccacgccttcagcgactac

SEQ ID NO: 43020 - DNA, 420 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgccggtgctgtgccaggcccacggcttgaccccccagcaggtggtggccatcgccagcaatggcggtggagacctcaagaaagcaatcccacctcactgcttcaaacgctccatccctcgctccttctcctacctcctcttcgacatcctcgtctcctcccccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43021 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 43022 - DNA, 396 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgactcaagacgatagttaccggataaggcgcagcggtcgggctgaacggggggtcgaggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43023 - DNA, 378 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttttggagcagcaacgatgttacgcagcaggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43024 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaatgcgtcccctgcgagacaccaccattcactctaagacctcaagaaagcaatcccacctcactgcttcaaacgctccaccccacgctccttctcctcttcgacatcatcatctcctcctcggctcctccctctaccacctccccacagcctacttccctctcccttacctcgcctgacccctctactgggcctgccaaggctgcgtcctaacgggcctctgggtcatagcccacgagtgcggccaccacgccttcagcgactac

SEQ ID NO: 43025 - DNA, 292 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 43026 - DNA, 348 bp, Artificial
  Mutation in BnaC.FAD2.b introduced by TALE nuclease pair BnFAD2_T03
caggatccatgggtgcaggtggaagaatgcaagtctctcctccctacagctcccccgaaaccaaaaccctcgaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 43027 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 43028 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggagacctcaagaaagcaatcccaccccactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43029 - DNA, 345 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactactcaagaaagcaatcccaccgcactgtttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 43030 - DNA, 354 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43031 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctagaaagcaatcccacctcactgcttcaaacgctccatccctcgctccttctcctatctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43032 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43033 - DNA, 401 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggggggaaagccggcgaacgtggcgagaaaggaagggaagaaagcgaaaggagcgggcgctaggagacctcaagaaagcaatcccacctcactgcttcaaacgctccatcccacgctccttctcctcttcgacatcatcatctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 43034 - DNA, 348 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43035 - DNA, 285 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaagaaagcaatcccacctcactgcttcaaacgctccatccctcgctccttctcctacctcctcttcgacatcctcgtctcctcctccctctaccacctctccacagcctacttcccactcccttacctcgcctgacccctctactgggcctgccaaggctgcgtcctaacgggcctctgggtcatagcccacgagtgcggccaccacgccttcagcgactac

SEQ ID NO: 43036 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgttccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgcgcctgccaaggctgcgtcctaacgggcctctgggtcatagcccacgagtgcggccaccacgccttcagcgactac

SEQ ID NO: 43037 - DNA, 348 bp, Artificial
  Mutation in BnaC.FAD2.b introduced by TALE nuclease pair BnFAD2_T03
caggatccatgggtgcaggtggaagaatgcaagtctctcctcccttcagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggccggccaaggctgcgtcctaacgggcctcggggtcatcgcccacgaatgcggccaccacgccttcagcgactac

SEQ ID NO: 43038 - DNA, 322 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgcaccctgcgagacaccaactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43039 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctgacctcaagaaagcaatcccacctcactgcttcaaacgctccatcccacgctccttctcctcttcgtcatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43040 - DNA, 318 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggagacctcaagaaagcaatcccacctcactgcttcaaacgctccatcccacgctccttctcctcttcgacatcatcatctcctcctcggctcctccctcaccctctctcctacttcgcctggcctctctactgggcctgccagggctgcgtcctaaccggcgtctgggtcatagcccacgagtgcggccaccacgccttcagcgactac

SEQ ID NO: 43041 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcgaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43042 - DNA, 292 bp, Artificial
  Mutation in BnaC.FAD2.b introduced by TALE nuclease pair BnFAD2_T03
caggatccatgggtgcaggtgaaagaatgcaagtctctcctccctccagctcccccgaaaccaaaaccctcaaccgcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttgagcgactac

SEQ ID NO: 43043 - DNA, 279 bp, Artificial
  Mutation in BnaC.FAD2.b introduced by TALE nuclease pair BnFAD2_T03
caggatccatgggtgcaggtggaagaatgcaagtgtctcctccctccagctcctccgaaaccaaaaccctcaaacgcgtcccctgcgagacaccacccttcactcttcgacatcctcgtctcctcctccctctaccacctctctacagcctacttccctctcctcccccaccctctcccttccctcgcctggcccctctactgggcctgccaaggctgcgtcctaacgggcctctgggtcatcgcccacgaatgcggccacaacgccttcagcgactac

SEQ ID NO: 43044 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctacgagacaccacccttcactctagagacctcaagaaagcaatcccacctcactgcttcaaacgctccatcccacgctccttctcctcttcgacatcatcatctcctcctcggctccccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43045 - DNA, 377 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacacccgcttcctcgctcactgactcgctgcgctcggtcgttcggctgcggcgagcggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43046 - DNA, 329 bp, Artificial
  Mutation in BnaC.FAD2.b introduced by TALE nuclease pair BnFAD2_T03
caggatccatgggtgcaggtggaagaatgcaagtctctcctccctccagctccccaggaaccaacaccctcaaacgcgtcccctgcgagacaccacccttcactccacctcactgcttcaaacgctccatccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatagcccacgagtgcggccaccacgccttcagcgactac

SEQ ID NO: 43047 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactcc

SEQ ID NO: 43048 - DNA, 349 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgtcagggctgcgtcctaaccggcgtctgggtcatagcccacgagtgcggccaccacgccttcagcgactac

SEQ ID NO: 43049 - DNA, 333 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcactctcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43050 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgagtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggccgcgtccgaacggtcctctgggtcatagcccacgagtgcggccaccacgccttcagcgactac

SEQ ID NO: 43051 - DNA, 350 bp, Artificial
  Mutation in BnaC.FAD2.b introduced by TALE nuclease pair BnFAD2_T03
caggatccatgggtgcaggtgggagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctccctgacctcgcctggcccctctactgggcctgccaaggctgcgtcctaacgggcctctgggtcatagcccacgagtgcggccaccacgccttcagcgactac

SEQ ID NO: 43052 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43053 - DNA, 350 bp, Artificial
  Mutation in BnaC.FAD2.b introduced by TALE nuclease pair BnFAD2_T03
caggatccatgggtgcaggtggaagaatgcaagtctctcctccctccagctccaccggaaccaacaccctcaaacgcgtcccctgcgagacaccacccttcactctagacctcaagaaagcaatcccacctcactgcttcaaacgctccatccctcgctcattctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43054 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactcaagaaagcaatcccacctcactgcttcaaacgctccatccctcgctccttttcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43055 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttagacctcaagaaagcaatcccacctcactgcttcaaacgctccatccctcgctccttctcctacctcctcttcgacatcctcgtctcctcctccctctaccacctctccacagcctacttccatctcctcccccaccctctcccttccctcgcctggcccctctactgggcctgccaaggctgcgtcctaacgggcctctgggtcatcgcccacgaatgcggccaccacgccttcagcgactac

SEQ ID NO: 43056 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccccgcgagacaccacccttcactctctcaagaaagcaatcccacctcactgcttcaaacgctccatccctcgctccttctcatcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43057 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 43058 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttttcctacctcctcttcgacatcctcgtctcctcctccctctaccacctctccacagcctacttccctctcctcccccaccctctcccttacctcgcctggcccctctactgggcctgccaaggctgcgtcctagcagccgtcgaggtcaaagccagagagcgcggccaccacgccttcagcgactac

SEQ ID NO: 43059 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43060 - DNA, 336 bp, Artificial
  Mutation in BnaC.FAD2.b introduced by TALE nuclease pair BnFAD2_T03
caggatccatgggtgccaggtggaagaatgcaagtctctcctccctccagctcccccgaaaccaaaaccctcaaacgcgtcccctgcgagacacacctcaagaaagcaatcccacctcactgcttcaaatgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 43061 - DNA, 428 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggccgccattgctggagatggccaccacctgctgaggggtcaagccgtgggcctggcacagcaccggcaacagccgagacctcaagaaagcaatcccacctcactgcttcaaacgctccatcccacgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 43062 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43063 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctagcaggcgctggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43064 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 43065 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 43066 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccacctcactgcttcaaacgctccatcccacgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43067 - DNA, 397 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagccgaacgaccgagcgcagcgagtcagtgagcgaggaagcggaagagcgcccaatacgcggagacctcaagaaagcaatcccacctcactgcttcaaacgctccatcccacgctccttctcctcttcgacatcatcatctcctcctcggctcctccctctaccacctctccacagcctactgccctctcccttacctcgcctgacccctctactgggcctgccaaggctgcgtcctaaccggcgtctgggtcatagcccacgagtgcggccaccacgccttcagcgactac

SEQ ID NO: 43068 - DNA, 371 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaacatcaaacgcgtcccctgcgagacaccacccttcactctcgccggtgctgtgccaggcccagccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43069 - DNA, 389 bp, Artificial
  Mutation in BnaC.FAD2.b introduced by TALE nuclease pair BnFAD2_T03
caggatccatgggtgcaggtggaagaatgcaagtctctcctcccttcagctcccccgaaaccaaaaccctcaaacgcgtcccctgcgagacaccacccttcactctcgcaattaatacgcgtaccgctagccggaagagtttgtagaaacgcaaaacggagacctcaagaaagcaattccacctcactgcttcaaacgctccatcccaccctccttctcctcttcgacatcatcatctcctcctcggctcctccccctaccacctcaccacagcctacttccctctcccttacctcgcctgacccctctactgggcctgccagggctgcgtcctaaccggcgtctgggtcatagccctcgagtgcggccaccacgccttcagcgactac

SEQ ID NO: 43070 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaactctcaaacgcgtcccctgcgagacaccacccttcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccactagtgcggccaccacgccttcgcgactac

SEQ ID NO: 43071 - DNA, 433 bp, Artificial
  Mutation in BnaC.FAD2.b introduced by TALE nuclease pair BnFAD2_T03
caggatccagggtgcaggtggaagaatgcaagtgtctcctccctccaagaagtctgaaaccgacaccatcaagcgcgtaccctgcgagacaccgcccttcactgttgtccagcggctgttgccggtgctgtgccaggcccacggcttgaccccccagcaggtggtggccatcgccagcaatggcggtggaggcctcaagaaagcaatcccacctcactgcttcaaacgctccatccctcgctccttctcctacctcctctgcagcatcctcgtctcctcccccctcgaccacctcgccacagcctacttccctcccctcccccaccctctcccttacctcgcctggcccctctactgggcctgccaaggctgcgtcctaacgggcctctgggtcatcgcccacgaatgcggccaccacgccttcagcgactac

SEQ ID NO: 43072 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctgctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43073 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccatgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 43074 - DNA, 342 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 43075 - DNA, 349 bp, Artificial
  Mutation in BnaC.FAD2.b introduced by TALE nuclease pair BnFAD2_T03
caggatccatgggcgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctacctcctcttcgacatcctcgtctcctcctccctctaccacctctccacagcctacttccctctcctccaccaccctctcccttacctcgcctggcccctctacggggcctgccaaggctgcgtcctaacgggcctctgggtcatcgcccacgaatgcggccaccacgccttcagcgactac

SEQ ID NO: 43076 - DNA, 304 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43077 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 43078 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43079 - DNA, 349 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 43080 - DNA, 341 bp, Artificial
  Mutation in BnaC.FAD2.b introduced by TALE nuclease pair BnFAD2_T03
caggatccatgggtgcaggtggaagaattcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43081 - DNA, 351 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43082 - DNA, 333 bp, Artificial
  Mutation in BnaC.FAD2.b introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43083 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43084 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcaaagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43085 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaacactcaaacgcgtcccctgcgagccaccacccttcaagaaagcaatcccacctcactgcttcaaacgctccatccctcgctccttctcctacctcctcttcgacatcctcgtctcctcctccctctaccacctctacacagcctacttccctctcctcccccaccctcgcccttacctcgcctggcccctctactgggcctgccaaggctgcgtcctaacgggcctctgggtcatagcccacgagtgctgccaccacgccatcagcgactac

SEQ ID NO: 43086 - DNA, 350 bp, Artificial
  Mutation in BnaC.FAD2.b introduced by TALE nuclease pair BnFAD2_T03
caggatccatgggtgcaggtggaagaatacaagtctctcctccctccagctcccccgaaaccaaaaccatcaaacgcgtcccctgcgagacaccacccttccctcgagacctcaagaaagcaatcccacctcactgcttcaaacgctccctccctccctccttctcctacctcctcttcgacatcctcgtctcctcctccctccaccacctctccacagcctacttccctctcctcccccaccctctcccttgcctcgcctggcccctctacggggcctgccaaggctgcgtcctaacgggcctctgggtcatcgcccacgaatgcggccaccacgccttcagcgactac

SEQ ID NO: 43087 - DNA, 378 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacacgcctgcttgccgccatcgtggctggcgatggccaccacctgctcctggcacagcagagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43088 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 43089 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctcaagaaagcaatcccacctcactgcttcaaacgctccatcccacgctccttctcctacctcctcttcgacatcctcgtctcgtcctccctctaccacctctccacagcctacttccctctcctccaccaccctctcccttacctcgcctggcccctctactgggcctgccaaggctgcgtcctaacgggcctctgggtcatcgcccacgaatgcggccaccacgccttcagcgactac

SEQ ID NO: 43090 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43091 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttagacctcaagaaagcaatcccacctcactgcttcaaacgctccatcccacgccccttctcctcttcgacatcatcatctcctcctcggctcctccctctaccacccctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43092 - DNA, 348 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaacatcaagcgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43093 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctaccttacctcgcctgacccctctactgggcctgccaaggctgcgtcctaacgggcctctgggtcatagcccacgagtgcggccaccacgccttcagcgactac

SEQ ID NO: 43094 - DNA, 418 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgcgagacaccaccatgcaagtccctcctccctccagctcccacggtaccaacaccctcaaacgcgcccccttcgagacaccaccacctcaagaaagcaatcccacctcactgcttcaaacgctccatcccacgctccttctcctcttcgacaccatcatctcctcctcgactcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43095 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43096 - DNA, 322 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43097 - DNA, 349 bp, Artificial
  Mutation in BnaC.FAD2.b introduced by TALE nuclease pair BnFAD2_T03
caggatccatgggtgcaggtggaagaatgcaagtctctcctccatccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatactcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 43098 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaacaaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 43099 - DNA, 350 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactcgagacctcaagaaagcaatcccacctcactgcttcaaacgctccatccctcgctccttctcctacctcctcttcgacatcctcgtctcctcctccctctaccacctctccgcagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43100 - DNA, 426 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctccccccagcaggtggtggccatcgccagcaatggcggtggcaagcaggcgctggagacggtccagcggctgttgccggtgctgtgccaggagacctcaagaaagcaatcccacctcactgcttcaaacgctccatcccacgctccttctcctcttcgacatcatcatctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 43101 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgctaaggctgcgtcctaacgggcctctgggtcatcgcccacgaatgcggccaccacgccttcagcgactac

SEQ ID NO: 43102 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaaactcaagaaagcaatcccaccgcactgtttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43103 - DNA, 401 bp, Artificial
  Mutation in BnaC.FAD2.b introduced by TALE nuclease pair BnFAD2_T03
caggatccatgggtgcaggtggaagaatgcaagtgtctcctccttccaaaaagtctgaaaccgacaacatcaagcgcgtaccctgcgagacaccgcccttcactgtcggggtcaagccgtgggcctggcacagcaccggcaacagccgctggaccgtctccaggagaactcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43104 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcactcacccctccctgcttcaaacgatccatcccaccctccttctcctcctcgacatcatcatctcctcctcgcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43105 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 43106 - DNA, 337 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43107 - DNA, 337 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43108 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaaacaatcccacctcactgcttcaaacgctccatccctcgctccttctcctacctcctcttcgacatcctcgtcgcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 43109 - DNA, 354 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctcgggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43110 - DNA, 322 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43111 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccctggaaccaacaccctcaaacgcgtcccctgcgagacaccaccattcactctcagacctcacgaaaacactcccccctcactccttcaaacactccctcccactctccttctcctcttcgtcatcaccatctcctccacggcccctccctcttccacctctcccccgcctacctccctctcccttacctcgcctgacccctctactgggcctgccaaggctgcgtcctaacgggcctctgggtcatagcccacgaatgcggccaccacgccttcagcgactac

SEQ ID NO: 43112 - DNA, 357 bp, Artificial
  Mutation in BnaC.FAD2.b introduced by TALE nuclease pair BnFAD2_T03
caggatccatgggtgcaggtggtagaatgcaagtctctcctccctccagctcccccggaaccaacaccctcaaacgcgtcccctgcgagacaccaccattcactctcggcgggtgtggtggttacgtagacctcaagaaagcaatcccacctcactgcttcaaacgctccatcccacgctccttctcctcttcgacatcatcatcccctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43113 - DNA, 349 bp, Artificial
  Mutation in BnaC.FAD2.b introduced by TALE nuclease pair BnFAD2_T03
caggatccatgggtgcaggtggaagaattcaagtgtctcctccctccaaaaagtctgaaaccgacaacatcaaacgcgtcccctgcgagacaccacccttcactcagacctcaagaaagcaatcccacctcactgcttcaaacgctccatccctcgctccttctcctacctcctcttcgacatcctcgtctcctcctccctctaccaccgctccacagcctacttccatctcctcccccaccctcgcccttacctcgcctgacccctctactgggcctgcctgggctgcttcttaacgggcctctgggtcatctcccacgagtgcggccaccgcgccttcagcgactac

SEQ ID NO: 43114 - DNA, 370 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtggataaccgtattaccgcctttgagtgagctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43115 - DNA, 427 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtgttgtgccaggcccacggcttgaccccggagcaggtggtggccatcgccagccacgatggcggcaacagccgctggacccagacctcaagaaagcaatcccacctcactgcttcaaacgccccatcccacgctccttctcctcttcgccatcctcgtctcctcctccctctaccacctctccacagcctacttccctctcctcccccaccctctcccttccctcgcctgacccctctactgggcctgccaaggctgcgtcctaaccggcgtctgggtcatagcccacgagtgcggccaccacgccttcagcgactac

SEQ ID NO: 43116 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggacaccacgccttcagactac

SEQ ID NO: 43117 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctcagggtcatcgcccacgaatgcggccaccacgccttcagcgactac

SEQ ID NO: 43118 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaacgggcctctgggtcatcgcccacgaatgcggccaccacgccttcagcgactac

SEQ ID NO: 43119 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43120 - DNA, 400 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggcaccggcaacagccgctggaccgtctccagcgcctgcttgccaccagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43121 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacttcgcctggcctctctactgggcctgccagggctgcgtcctaaccggcgtctgggtcatagcccacgagtgcggccaccacgccttcagcgactac

SEQ ID NO: 43122 - DNA, 337 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcacttctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43123 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctacaagacctcaagaaagcgatcccacctcactgcttcaaacgctccatcccacgctccttctcctcttcgacatcatcatctcctcctcggctcctccctctaccacctctccacagcctacttccctctcccttacctcgcctgacccctctactgggcctgccacggctgcgtcctaacgggcctctgggtcatagcccacgcgtgcggccaccacgccttcagcgactac

SEQ ID NO: 43124 - DNA, 349 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccaccattcactcagacctcaagaaagcaatcccacctcactgattcaaacgcaccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43125 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatccctcgctccttctcctacctccgcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43126 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43127 - DNA, 332 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccaccattcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43128 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 43129 - DNA, 349 bp, Artificial
  Mutation in BnaC.FAD2.b introduced by TALE nuclease pair BnFAD2_T03
caggatccatgggtgcaggtggaagaatgcaagtctctcctccttccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43130 - DNA, 329 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43131 - DNA, 386 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccatgcgagacaccacccttcactgtcgccagccacgatggcggcaacagccgctggaccggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 43132 - DNA, 437 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggcgtcctgcccgccaccctccgggccgttgcttcacaacgttcaaatccgctcccggcggatttgtcctactcaggagagcgttcaccgacaaacaacagataaaacgaaaggcccagtcttccactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43133 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtcccctgcgagacaccaccattcactcagacctcaagaaagcaatcccacctcactgcttcaaacgctccatcccaccctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43134 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtatcatcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 43135 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 43136 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccatcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43137 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 43138 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccatcagcgactac

SEQ ID NO: 43139 - DNA, 392 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacgctcaagtcagaggtggcgaaacccgacaggactataaagataccaggcgttagacctcaagaaagcaatcccacctcactgcttcaaacgctccatcccacgctccttctcctcttcgacatcatcatctcctcctcggctcctccctctcccacctcaccccagcctacttccctctcccttacctcgcctgacccctctactgggcctgccaaggctgcgtcctaacgggcctctgggtcatagcccacgagtgcggccaccacgccttcagcgactac

SEQ ID NO: 43140 - DNA, 348 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 43141 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgacctcaagaaagcaatcccacctcactgcttcaaacttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43142 - DNA, 432 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcacggcgatggccaccacctgctccggggtcaagccgtgggcctggcacactccgggccgttgcttcacaacgttcaaatccgctcccggcggatttgtcctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43143 - DNA, 311 bp, Artificial
  Mutation in BnaC.FAD2.b introduced by TALE nuclease pair BnFAD2_T03
caggatccatgggtgcaggtcgaagaatgcaagtctctcctccctccagctcccccggaaccaacaccctcaaacgcgtcccctgcgagacaccaccattcactctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43144 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43145 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43146 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 43147 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43148 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43149 - DNA, 282 bp, Artificial
  Mutation in BnaC.FAD2.b introduced by TALE nuclease pair BnFAD2_T03
caggatccatgggtgcaggtggaagaatgcaagtctctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgtcaaggctgcgtcctaacgggcctctgggtcatcgcccacgaatgcggccaccacgccttcagcgactac

SEQ ID NO: 43150 - DNA, 349 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 43151 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggcctccacgccttcagcgactac

SEQ ID NO: 43152 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcacctgcgagacaccacccttcactctcggcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43153 - DNA, 328 bp, Artificial
  Mutation in BnaC.FAD2.b introduced by TALE nuclease pair BnFAD2_T03
caggatccatgggtgcaggtggaagaatgcaagtgtctcctccctccaagaagactgaaaccgacaccatcaagcgcgtaccctgcgagacaccgcccttcactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43154 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgccagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctagccggcgtctgggtcatagcccacgagtgcggccaccacgccctcagcgactac

SEQ ID NO: 43155 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcacgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccccgaatgcggccaccacgccttcagcgactac

SEQ ID NO: 43156 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacctcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43157 - DNA, 401 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttggccaccacctgctgaggggtcaagctgtgggcctggcacagcaccggcaacagccgctggaggagacctcaagaaagcaatcccaccgcactgtttcaaacgctcgatccctcgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43158 - DNA, 399 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcggatggcctttttgcgtttctacaaactcttcctggctagcggtactcggagacctcaagaaagcaatcccacctcactgcttcaaacgctccatccctcgctccttctcctacctcctcttcgacatcctcgtctcctcctccctctaccacccctccacagcctacttccctctcctcccccaccctctcccttacctcgcctggcccctctacggggcctgccaaggctgcgtcctaacgggcctctgggtcatcgcccacgaaggcggccaccacgccttcagcgactac

SEQ ID NO: 43159 - DNA, 457 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcatcatataatttctgttgaattacgttaagcatgtaataattgatggccagcaatattggtggcaagcaggcgctggagacggtgcaggcgctgttgccggtgctgtgccaggcccacggcttgacctcaagaaagcaatcccacctccctgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 43160 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctcttcgacatcatcatctcctcctcggctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 43161 - DNA, 336 bp, Artificial
  Mutation in BnaC.FAD2.b introduced by TALE nuclease pair BnFAD2_T03
catggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43162 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcaccctagacctcaagaaagcaatcccacctcactgcttcaaacgctccatccctcgctccttctcctacctcctcttcgacatcctcgtctcctcctccctctaccacctctccacagcctacttccctctcctcccccaccctcccccttccctcgcctggcccctctactgggcctgccaaggctgcgtcctaacgggcctctgggtcatagcccacgagtgcggccaccacgccttcagcgactac

SEQ ID NO: 43163 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 43164 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctacttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43165 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtaccctgcgagacaccgcccttcactgtaagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctgacgggcctctgggtcatagcccacgagtgcggccaccacgccttcagcgactac

SEQ ID NO: 43166 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgtagaactcaagaaagcaatcccaccgcactgcttcaaacgctccatccctcgctccttctcctacctcctcttcgacatcctcgtctcctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 43167 - DNA, 308 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 43168 - DNA, 392 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccagcgcctgcttgccaccattattgctggcgatggccaccacctgctggggggtcaagttgagcggggcacccggcagtgcattgcgccagagacctcaagaaagcaatcccacctcactgcttcaaacgctccatcccacgctccttctcctcttcgacatcatcatctcctcctcggctcctccctctcccacctctccacagcctccttcccgctcccttccctcgcctgacccctctactgggcctgccaaggctgcgtcctaacgggcctctgggtcatagcccacgagtgcggccaccacgccttcagcgactac

SEQ ID NO: 43169 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacacgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43170 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaacgggcctctgggtcatcgcccacgaatgcggccaccacgccttcagcgactac

SEQ ID NO: 43171 - DNA, 333 bp, Artificial
  Mutation in BnaC.FAD2.b introduced by TALE nuclease pair BnFAD2_T03
caggatccatgggtgcaggtgcaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaacgggcctcggggtcatagcccgcaagtgcggccaccacgccatcagcgactac

SEQ ID NO: 43172 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccccgaatgcggccaccacgccttcagcgactac

SEQ ID NO: 43173 - DNA, 402 bp, Artificial
  Mutation in BnaC.FAD2.b introduced by TALE nuclease pair BnFAD2_T03
caggatccatgggtgcaggtggaagaatgcaagtgtctcctccctccaaaacgtctgaaaccgacaacatcaagcgcgtaccctgcgagacaccgcccttcactgtcggggtcaagccgtgggcctggcacaccacctgcaagcaggcgctcaacacgagaactcaagaaagcaaccccaccgcactgtttcaaacgctcgatccctcgctctttctcctacctcctcttcgacatcctcgtctcctcctccctccaccacccctccccagcctacctccccctccccccccaccctctcccttacctcgcctggcccctctactgggcctgccaaggctgcgtcctaacgggcctctgggtcatcgcccacgaatgcggccaccacgccttcagcgactac

SEQ ID NO: 43174 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacactccatccctcgctccttctcctacctcctcttcgacatcctcgtctcctcctccctctaccacctctccacagcctacttccctctcctcccccaccctctccctgacctcgcctgacccctctactgggcctgccaaggctgcgtcctaacgggcctctgggtcatagcccacgagtgcggccaccacgccttcagcgactac

SEQ ID NO: 43175 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43176 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctcctgggcctgccaaggctgcgtcctaacgggcctctgggtcatcgcccacgaatgcggccaccacgccttcagcgactac

SEQ ID NO: 43177 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggagaaagcaatcccacctcactgcttcaaacgccccatccctcactccttctcctacctcctcttcgccatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43178 - DNA, 411 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggttcagcctggtcagctgggccttgtagttgcccttgaagtggccggacacgaacaggagaactcaagaaagcaatcccaccccactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43179 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 43180 - DNA, 322 bp, Artificial
  Mutation in BnaC.FAD2.b introduced by TALE nuclease pair BnFAD2_T03
caggatccatgggtgcaggtgggagaatgcaagtctctcctccctccagctcctccggaaccaacaccctcaaaacgcgtcccctgttatcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43181 - DNA, 414 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcactctcggcttgaccccccagcaggtggtggccatcgccagccacgatggcggcaacagccgctggaccagacctcaagaaagcaatcccacctcactgcttcaaacgctccatccctcgctccttctcctacctcctcttcgacatcctcgtctcctcctccccctaccacctctccccagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43182 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgctcacgaatgcggccaccacgccttcagcgactac

SEQ ID NO: 43183 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctagcgggcctctgggtcatagcccacgagtgcggccacctcgccttcagcgactac

SEQ ID NO: 43184 - DNA, 264 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43185 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43186 - DNA, 334 bp, Artificial
  Mutation in BnaC.FAD2.b introduced by TALE nuclease pair BnFAD2_T03
aggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 43187 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccgcgagtgcggccaccacgccttcagcgactac

SEQ ID NO: 43188 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccactccatcagcgactac

SEQ ID NO: 43189 - DNA, 353 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43190 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccatggcggacctcaagaaagcaatcccaccttactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43191 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttttggagacctcaagaaagcaatcccacctcactgcttcaaacgctccatcccacgctccttctcctcttcgacatcatcatctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 43192 - DNA, 337 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaaactcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggccatcgcccacgaatgcggccaccacgccttcagcgactac

SEQ ID NO: 43193 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 43194 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacctcaagaaagcaatcccacctcactgcttcagacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43195 - DNA, 319 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43196 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaaacaatcccacctcactgcttcaaactccccatcccaccctccttctcctcttcgactacatcatctcttcctctgctcctccctctactacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43197 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgccccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 43198 - DNA, 328 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43199 - DNA, 392 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacgctcaagtcagaggtggcgaaacccgacaggactataaagataccaggcgttagacctcaagaaagcaatcccacctcactgcttcaaacgctccatcccacgctccttctcctcttcgacatcatcatctcctcctcggctcctccctctcccacctccccacagcctacttccctctcccttacctcgcctgacccctctactgggcctgccaaggctgcgtcctaacgggcctctgggtcatagcccacgagtgcggccaccacgccttcagcgactaa

SEQ ID NO: 43200 - DNA, 420 bp, Artificial
  Mutation in BnaC.FAD2.b introduced by TALE nuclease pair BnFAD2_T03
caggatccatgggtgcaggtggaagaatgcaagtctctcctcactccagctcccccgaaaccaaaaccctcaaacgcgtcccctgcgagactccacccttcactctcggaccgtctccagcgcctgcttgccacagccattgctggcgatggccaccacctgctggggggtcaagccgtgggcctggcggcgacctcaagaaagcaatcccacctcactgcttcaaacgctccatcccacgctccttctccgctacgacgtcatcatctcctcctcggctcctccctctaccacctctccgcggcctacttccctcgcccttgcctcgcctggcccctctactgggcctgccaaggctgcgtcctaaccggcgtctgggtcatatcccacgagtgcggccaccacgccttcagcgactac

SEQ ID NO: 43201 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccatcaaacgcgtcccctgcgagacaccaccattcactcagacatcaagaaagaaatcccacctcactgattcaaacgcaccatcccacgctccttctcctcttcgacatcatcatctcctcctcggctcctcccgctcccacctctccacagcctacttccctctcccttacctcgcctggcccctctactgggcctgccagggctgcgtcctaacgggcctctgggtcatagcccacgagtgcggccaccacgccttcagcgactac

SEQ ID NO: 43202 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggacccaacaccctcaaacgcgtcccctgcgagacacctccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 43203 - DNA, 336 bp, Artificial
  Mutation in BnaC.FAD2.b introduced by TALE nuclease pair BnFAD2_T03
caggatccatgggtgcaggtggaagaattcaagtctctcctccctccagctcccccgaaaccaaaacactcaaacgcgtcccctgcgagacaccacccttcactctccatcccacctcactgcttcaaacgctccatccctcgctccttctcctacctcctcttcgacatcctcgtctcctcctccctctaccacctctccacagtctacttccctctcctccccccccccctcccttacctcgcctgacccctctacggggcctgccaaggctgcgtcctaacgggcctctgggtcatagcgcacgagtgcggccaccacgccttcagcgactac

SEQ ID NO: 43204 - DNA, 348 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43205 - DNA, 350 bp, Artificial
  Mutation in BnaC.FAD2.b introduced by TALE nuclease pair BnFAD2_T03
caggatacatgggtgcaggtggaagaatgcaagtgtctcctccctccaagaagtctgaaaccgacaccatcaagcgcgtaccctgcgagacaccgcccttcactggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43206 - DNA, 368 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagcaatggcggtggctggagaactcaagaaagcaatcccacctcactgcttcaaacgctccatccctcgctccttctcctacctcttcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgtggccaccacgccttcagcgactac

SEQ ID NO: 43207 - DNA, 419 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccatcaaacgcgtcccctgcgagacaccaccattcactctcggcaacagccgctggaccgtctccagcgcctgcttgccaccattattgctggcgatggccaccacctgccatcccacgttccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43208 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcacttaacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43209 - DNA, 419 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactcttggggggtcaagccgtgggcctggcacagcaccggcaacagccgctggaccgtctccagcgcctgcttgagacctcaagaaagcaatcccacctcactgcttcaaacgctccatccctcgctccttctcctacctcctcttcgacatcctcgtctcctcccccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43210 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgacctcaagaaagcaatcccacctcactgcttcaaacgctccatccctcgctccttctcctcttcgacatcatcatctcctcctcggctcctccctctcccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 43211 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43212 - DNA, 334 bp, Artificial
  Mutation in BnaC.FAD2.b introduced by TALE nuclease pair BnFAD2_T03
caggtccatgggtgcaggtggaagaatgcaagtctctcctccctccagctcccccggaaccaacaccctcaaacgcgtcccctgcgagacaccaccattcactcggacctcaagaaagcaatcccacctcactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43213 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgctaaggctgcgtcctaacgggtctctgggtcatcgcccacgaatgcggccaccacgccttcagcgactac

SEQ ID NO: 43214 - DNA, 276 bp, Artificial
  Mutation in BnaC.FAD2.b introduced by TALE nuclease pair BnFAD2_T03
caggatccatgggtgcaggtggaagaatgcaagtctctcctctcggagacctcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 43215 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcgggggcatagcccacgagtgcggccaccacgccatcagcgactac

SEQ ID NO: 43216 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaacgggcctctgggtcatagcccacgagtgcggccaccacgccttcagcgactac

SEQ ID NO: 43217 - DNA, 363 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgcgatggcggcaagcaggcgctggagaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43218 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 43219 - DNA, 308 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43220 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 43221 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43222 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43223 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccatcggagacctcaagaaagcaatcccacctcactgcttcaaacgctccatcccacgctccttctcctcttcgacatcatcatctcctcctcggctcctccctctaccacctctccacagcctactttcctctcccttacctcgcctgacccctctactgggcctgccaaggctgcgtcctaaccggcgtctgggtcatagcccacgagtgcggccaccacgccttcagcgactac

SEQ ID NO: 43224 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccaaaaccaaaaccctcaaacgcgtcccctgcgagacaccacccttcactggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43225 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatatcccgcgagtgcggccaccacgccatcagcgactac

SEQ ID NO: 43226 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 43227 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctacttggcctgccaaggctgcgtcctaacgggcctctgggtcatagcccacgagtgcggccaccacgccttcagcgactac

SEQ ID NO: 43228 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43229 - DNA, 356 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacacttcactctcgggggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43230 - DNA, 280 bp, Artificial
  Mutation in BnaC.FAD2.b introduced by TALE nuclease pair BnFAD2_T03
caggacatgggtgcaggtggaagaatgcaagtctctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43231 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatcccacgctccttctcctcttcgacatcatcatctcctcttcggctcctccctctaccacctctccacagcctacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 43232 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttaacctcaagaaagcaatcccacctcactgcttcaaacgctccatccctcactccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43233 - DNA, 400 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcccacggcttgaccccccagcaggtggtggccatcgccagcaatggagacctcaagaaagcaatcccacctcactgcttcaaacgctccatcccacgctccttctcctcttcgacatcatcatctcctcctcggctcctccctctaccccctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 43234 - DNA, 343 bp, Artificial
  Mutation in BnaC.FAD2.b introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgttagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43235 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacacgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgctgccaccacgccttcagcgactac

SEQ ID NO: 43236 - DNA, 354 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43237 - DNA, 332 bp, Artificial
  Mutation in BnaC.FAD2.b introduced by TALE nuclease pair BnFAD2_T03
caggatccatgggtgcaggtggaagaatgcaagtctctcctccctccagctccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43238 - DNA, 334 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtcccctgcgagacaccacccttcactcgacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccagggctgcgtcctaacgggcctctgggtcatcgcccacgaatgcggccaccacgccttcagcgactac

SEQ ID NO: 43239 - DNA, 363 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcggcgggtgtggtggttacgcccaaagacctcaagaaagcaatcccacctcactgcttcaaacgctccatcccacgctccttctcctcttcgacatcatcatcccctccccggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43240 - DNA, 371 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacaaccattcactctcggcggggggggggggtacgtagacctcaagaaagcaaacccacctcactgcttcaaacgctccaaccctcgctccttctcctacctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 43241 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43242 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactcttagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 43243 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43244 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctggcccctctactgggcctgccaaggctgcgtcctaacgggcctctgggtcatcgcccacgaatgcggccaccacgccttcagcgactac

SEQ ID NO: 43245 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43246 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgatacaccacccttcactcttcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 43247 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcctccgaaaccaaaaccctcaaacgcgtcccctgcgagacaccacccttcactacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 43248 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctccattacctcgcctgacccctctactgggcctgccaaggctgcgtcctaacgggcctctgggtcatagcccgcgagtgcggccaccacgccttcagcgactac

SEQ ID NO: 43249 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcacagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggttgcgtcctaacgggcctctgggtcatcgcccacgaatgcggccaccacgccttcagcgactac

SEQ ID NO: 43250 - DNA, 312 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacatcaagcaatcccaccgcactgtttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43251 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatagacctcaagaaagcacacccacctcactgcttcaaacgctccatcccacgctccttctcctcttcgacatcatcatcccctcctcggctcctccctctaccacctctccacagcctacttccctctcccttccctcgcctgacccctctactgggcctgccaaggctgcgtcctaacgggcctctgggtcatagcccacgagtgcggccaccacgccatcagcgactac

SEQ ID NO: 43252 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttccgactac

SEQ ID NO: 43253 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 43254 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 43255 - DNA, 394 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattggagacagggagacttttttttttttttttttatctttaatcaaatttgtacagtacaggggtcagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43256 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatcttctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43257 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 43258 - DNA, 401 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggagacggtccagcggctgttgccggtgctgtgccaggcccacggtccagcgcctgcttgccggagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43259 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggtcggagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 43260 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagttcgaccaccacgccttcagcgactac

SEQ ID NO: 43261 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctacgagacaccacccttcactctcggcctttttacggttcctctccctcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43262 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43263 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 43264 - DNA, 450 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgagcgatcgttggcgtcggcaaacagtggtccggcgcacgcgctctggaggccttgctcacggtggcgggagagttgagaggtccaccgttacagttggagaactcaagaaagcaatcccaccgcactgtttcaaacgctccatccctcgctccttcccctccctccccttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43265 - DNA, 334 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtcccctgcgagacaccacccttcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 43266 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccacccttcactacctcaagaaagcaatcccccctcactgctcaaaacgctccatccctccctcctcctcctacctcctcttcgacatcctcgtctcctcctccctctcccacctctccacagcctacttccctctcccttacctcgcctgacccctctactgggcctgccaagactgcgtcctaacgggcctctgggtcatagcccacgagtgcggccaccacgccttcagcgactac

SEQ ID NO: 43267 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtaaactcaagaaagcaatcccacctcactgcttcaaacgctccatccctcgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43268 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 43269 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacatcgcctggcccctctactgggcctgccaaggctgcgtcctaacgggcctctgggtcatcgcccacgaatgcggccaccacgccttcagcgactac

SEQ ID NO: 43270 - DNA, 363 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcggcgggtgtggtggttacgcgcaaagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 43271 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43272 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacacgtcccctgcgagacaccaccattcacatgagacctcaagaaagcaatcccacctcactgcttcaaacgctccatcccacgctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43273 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccgtcagcgactac

SEQ ID NO: 43274 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccgtcagcgactac

SEQ ID NO: 43275 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaaaaactcttggaagaactcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatcgcccacgaatgcggccaccacgccttcagcgactac

SEQ ID NO: 43276 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaactggcctctgggtcatagcccccgagtgcggccaccacgccttcagcgactac

SEQ ID NO: 43277 - DNA, 359 bp, Artificial
  Mutation in BnaC.FAD2.b introduced by TALE nuclease pair BnFAD2_T03
caggatccatgggtgcaggtggaagaatgcaagtctcccctccctccagctcccccgaaaccaaaaccctcaaacgcgtcccctgcgagacaccacccttcacgtctccagcgccagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 43278 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttccctcgcctggcccctctactgggcctgccaaggctgcgtcctaacgggcctctgggtcatcgcccacgaatgcggccaccacgccttcagcgactac

SEQ ID NO: 43279 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 43280 - DNA, 331 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacctcaagaaagcaatcccacctcactgcttcaaacgctccatccctcgctccttctcctacctcctcttcgacatcctcgtctccttctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 43281 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccatctcctcccccaccctctcccttacctcgcctggcccctctactgggcctgccaaggctgcgtcctaacgggcctctgggtcatagcccacgagtgcggccaccacgccttcagcgactac

SEQ ID NO: 43282 - DNA, 331 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcacaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctaccgggcctgccaaggctgcgtcctaacgggcctctgggtcatagccctcgagtgcggccaccacgccttcagcgactac

SEQ ID NO: 43283 - DNA, 332 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 43284 - DNA, 332 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatctcccacgagtgcggccaccactccctcagcgactac

SEQ ID NO: 43285 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaacctcaagaaagcaatcccacctcactgcttcaaacgctccatcccacgctccttctcctcttcgacatcatcatctcctcctcggctcctccctctaccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 43286 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtccgaacgggcctctgggtcatagccctcgagtgcggccaccacgccttcagcgactac

SEQ ID NO: 43287 - DNA, 342 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcttgaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43288 - DNA, 332 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcccaccgcactgtttcaaacgctcgatccctcgctctttctcctacctcatctgggacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43289 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccatcagcgactac

SEQ ID NO: 43290 - DNA, 338 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactactcaagaaagcaatcccacctcactgcttcaaacgctccatccctcgctccttctcctacctcctcttcgacatcctcgtctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 43291 - DNA, 345 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaatcccacctcactgcttcaaacgctccatccctcgctccttctcctacctcctcttcgacatcctcgtctcctcctccctctaccacctctccacagcctacttccctctcctcccccaccctctcccttaccccgcctggcccctctactgggcctgccaaggctgcgtcctaacgggcctctgggtcatagcccacgagtgcggccaccacgccttcacgactac

SEQ ID NO: 43292 - DNA, 346 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagaaagcaatcccacctcactgcttcaaacgctccatccctcgctccgtctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43293 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggtcaccacgccttcagcgactac

SEQ ID NO: 43294 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctatactgggcctgccaaggctgcgtcctaacgggcctctgggtcatagcccacgagtgcggccaccacgccttcagcgactac

SEQ ID NO: 43295 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaactcaagaaagcaatcccaccgcactgtttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43296 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43297 - DNA, 331 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcctcaagaaagcaatcccacctcactgcttcaaacgccccatccctcgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 43298 - DNA, 329 bp, Artificial
  Mutation in BnaC.FAD2.b introduced by TALE nuclease pair BnFAD2_T03
caggatccatgggtgcaggtggaagaatgcaagtgtctcctccctccagctcccccggaacaaacaccctcaaacgcgtcccctgcgagacaccaccattcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43299 - DNA, 431 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggcaggtggtggccatcgccagcaatggcggtggcaagcaggcgctggagacggtccagcggctgttgccggtgctgtgccaggcccacggctagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43300 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaacaaaaaccctcaaacgcgtcccctgcgagacaccacccttcactcacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 43301 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctgacccctctactgggcctgccaaggctgcgtcctaacgggcctctgggtcatagcccacgagtgcggccaccactccttcagcgactac

SEQ ID NO: 43302 - DNA, 304 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactgtttcaaacgctcgatccctcgctctttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 43303 - DNA, 317 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43304 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatgctccttaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43305 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctagacctcaagaaagcaatcccacctcactgcttcaaacgctccacccctcgccccttctcctacctcctcttcgacatcctcgtctcctcctccctctaccacctctccacagcctacttccctctcctcccccaccctctccctaacctcgccgggcccctctactgggccggccaaggcggcgtcataacgggcctctggatcatagcccacgagggcggccaccacgccttcagcgactac

SEQ ID NO: 43306 - DNA, 332 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgaactcaagaaagcaatcccaccgcactgtttcaaacgctcgatccctcgctccttctcctacctcctcttcgacatcctcgtctcctcctccctctaccacctctccacagcctacttccctctcccttacctcgcctgacccctctactgggcctgccaaggctgcgtcctaacgggcgtctgggtcatagcccacgagtgcggccaccacgccagcagcgactac

SEQ ID NO: 43307 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccatggcggacctcaagaaagcaatcccaccttactgcttcaaacgctccatcccacgctccttctcctcttcgacatcatcatctcctcctcggctcctccctctaccacctctccaaagcctacttccctctcctcccccaccctctcccttacctcgcctggcccctctactgggcctgccaaggctgcgtccgaacgggcctctgggtcatcgcccacgaatgcggccaccacgccttcagcgactac

SEQ ID NO: 43308 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgaaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43309 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaccgctccccctgcgggaccccacccttcactcctcaagaaagcaatcccacctcactgcttcaaacgcgccatccctcgctccttctcctacctccccttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43310 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccaccgcactgtttcaaacgctcgctccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43311 - DNA, 348 bp, Artificial
  Mutation in BnaC.FAD2.b introduced by TALE nuclease pair BnFAD2_T03
caggatccatgggtgcaggtggaagaatgcaagtctaccctccctccagctcccccgaaaccaaaaccctcaaacgcgtcccctgcgagacaccacccttcactcgacatcaagaaagcaatcccacctcactgcttcaaacgctccatccctcgctccttctcctacctcctcttcgacatcctcgtctcctcctccctctaccacctctccacagcctacttccctctcctcccccaccctctcccttgcctcgcctggcccctctactgggcctgccaagggtgcgtcctaaccggcgtctgggtcatagcccacgaatgcggccaccacgccttcagcgactac

SEQ ID NO: 43312 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcgaccaccacgccttcagcgactac

SEQ ID NO: 43313 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaaacgcgtcccctgttatcgagacatcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 43314 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagagcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacatcctacttccctctcctcccccaccctctcccttacctcgcctggcccctctactgggcctgccaaggctgcgtccaaacgggcctctggctcatcgcccacgaattcggccaccacgccttcagcgactac

SEQ ID NO: 43315 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccacctcactgcttcaaacgctccatcccacgctccttctcctcttcgacttcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 43316 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcaacatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43317 - DNA, 468 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcccccccagcaggtggtggccatcgccagcaatggcggtggcaagcaggcgctggagacggtccttgaacgttgtgaagcaccggcccggagggtggcgggcaggacgcccgccataaactaccaggcatcaagaaagcaatcccacctcactgcttcaaacgccccatccctcgctccttctcctccctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43318 - DNA, 336 bp, Artificial
  Mutation in BnaC.FAD2.b introduced by TALE nuclease pair BnFAD2_T03
cagtatccatgggtgcaggtggaagaattcaagtttttccttcttccagctcccccggaaccaacaccctcaaacgcgtcccctgcgagacaccaccattcactctagacctcaagaaattaatcctacctcactgcttcaatcgctccatcccacgctccttctcctcttcgacaacatcatctcctcctctgcccctccctctaccacctcaccacagcctacttccctctcccttacctcgccagacccctatactgggccggccaagaatgcgtcctaacgggcctctgggtcatagcccacgagggcggccaccacgccatcagcgactac

SEQ ID NO: 43319 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43320 - DNA, 434 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggaccgtctccagcgcctgcttgccaccgccattgctggcgatggccaccacctgctggggggtcaagccgtgggcctggcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43321 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctacagggcctgccaaggctgcgtcctaacgggcctctgggtcatagcccacgagtgcggccaccacgccttcagcgactac

SEQ ID NO: 43322 - DNA, 295 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccgcgaatgcggccaccacgccttcagcgactac

SEQ ID NO: 43323 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 43324 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactctcgggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 43325 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctacgggacctgccaaggctgcgtcctaacgggcctctgggtcatagcccacgagtgcggccaccacgccttcagcgactac

SEQ ID NO: 43326 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 43327 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagccgacttccctctcctcccccaccctctcccttaccacgcctggcccctctactgggcatgccaaggctgcgtcctaacgggcctctgggtcatagcccacgagtgcggccaccacgccatcagcaactac

SEQ ID NO: 43328 - DNA, 349 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaccatcaagcgcgtaccctgcgagacaccacccttcactcagacctcaagaaagcaatcccacctcactgcttcaaacgctccatccctcgatccttctcctacctcctcttcgacatcctcgtctcctcctccctctaccacctctccacagcctacttccctctcctcccccaccctctcccttaccgcgcctggcccctctactgggcctgccaaggctgcgtcctaacgggcctctgggtcatcgcccacgaatgcggccaccacgccatcagcgactac

SEQ ID NO: 43329 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccatcagcgactac

SEQ ID NO: 43330 - DNA, 358 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagatcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43331 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgtgacacaaccattcactcgagaccgcaagaaagcaatcccacctcaccgcttcaaacgacacatcccacactccttctcctcttctacatcctcgtctcctcctccccctaccacctctccaaagcctacttccctctcctcccccaccctctcccttacctcgcctggcccctctactgggcctgccaaggctgcgtccgaacgggcctctgggtcatcgcccaggaatgcggccaccacgccagcagcgactac

SEQ ID NO: 43332 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattaactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 43333 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43334 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgaccccaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43335 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgtgcctctgggtcatcgcccacgaatgcggccaccacgccttcagcgactac

SEQ ID NO: 43336 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcggagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 43337 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacaagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 43338 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgccgacgaatgcggccaccacgccttcagcgactac

SEQ ID NO: 43339 - DNA, 391 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctaggcgacgaggtggtcgttggtcaacgcggccaacgccgggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43340 - DNA, 378 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcctgcttgccaccgccattgctggcgatggccaccacctttgacctcaagaaagcaatcccacctcactgcttcaaacgctccatcccacgctccttctcctcttcgacatcatcatctcctcctcggctcctccctctaccacctctccccagcctacttccctctcccttacctcgcctgacccctctactgggcctgccaaggctgcgtcctaacgggcctctgggtcatagcccacgagtgcggccaccacgccttcagcgactac

SEQ ID NO: 43341 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43342 - DNA, 377 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaccgcgtcccctgcgagacaccaccattcactctgcgatggcggcaagcaggcgctggagaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctcgactgggcctgccaaggctgcgtcctaacgggcctctgggtcatcgcccacgagtgcggccaccacgccttcagcgactac

SEQ ID NO: 43343 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcttcccctgcgagacaccaccattcactctcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43344 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccgcgagtgcggccaccacgccatcagcgactac

SEQ ID NO: 43345 - DNA, 338 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43346 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcctctgggtcatagcccacgagtgcggccaccacgccttcagcgactac

SEQ ID NO: 43347 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 43348 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccgcgaatgcggccaccacgccttcagcgactac

SEQ ID NO: 43349 - DNA, 381 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccaccattcactctcggccttctgcttagtttgatgcctggcagtttatggcgggcataagacctcaagaaagcaatcccacctcactgcttcaaacgctccatcccacgctccttctcctcttcgacatcatcctctcctcctccgctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43350 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 43351 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacttggcctgccaaggctgcgtcctaacgggcctctgggtcatcgcccacgaatgcggccaccacgccttcagcgactac

SEQ ID NO: 43352 - DNA, 471 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcttgccggtgctgtgccaggcccacggcttgaccccccagcaggtggtggccatcgccagcaatggcggtggcaacagccgctggaccgttgccggtgctgtgccaggcccccggcttgaccccccagcaggtggtgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgcaaaggctgcgtcctaacgggcctctgggtcatagcccacgagtgcggccaccacgccttcagcgactac

SEQ ID NO: 43353 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccacctcactgcttcaaacgctccatccctcgctccttctcctacctcctcttcgacatcctcgtctcctcctccctctaccacctcgccacagcctacttccctctcctcccccaccctctcccttacctcgcctggccccgctactgggcctgccaaggctgcgtcctaacgggcctctgggtcatcgcccacgaatgcggccaccacgccttcagcgactac

SEQ ID NO: 43354 - DNA, 337 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccacctcactgcttcaaacgctccctcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43355 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccttgcgagacaccgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43356 - DNA, 305 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43357 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccacctcactgcttcaaacgctccatccctcgctccttctcctacctcctcttcgacatcctcgtctcctcctccctctaccacctctccacagcctacttccctctcctctcccaccctctcccttacctcgcctggcccctctactgggcctgccaaggctgcgtcctaacgggcctctgggtcatcgcccacgaatgcggccaccacgccttcagcgactac

SEQ ID NO: 43358 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagggcggccaccacgccttcagcgactac

SEQ ID NO: 43359 - DNA, 332 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43360 - DNA, 295 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgacta

SEQ ID NO: 43361 - DNA, 311 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatcaaacgctccatcccacgctccttctcctcttcgacatcatcatctcctcctcgcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43362 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43363 - DNA, 334 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtaatagcccacgagtgcggccaccacgccttcagcgactac

SEQ ID NO: 43364 - DNA, 354 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggagacctcaagaaagcaatcccacctcactgcttcaaacgctccatccctcgctccttctcctacctcctcttcgacatcctcgtctcctcctccctctaccacctctccacatcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43365 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 43366 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43367 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43368 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccatcagcgactac

SEQ ID NO: 43369 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43370 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgtcaaggctgcgtcctaacgggcctctgggtcatcgcccacgaatgcggccaccacgccttcagcgactac

SEQ ID NO: 43371 - DNA, 380 bp, Artificial
  Mutation in BnaC.FAD2.b introduced by TALE nuclease pair BnFAD2_T03
caggatccatgggtgcaggtggtagaatgcaagtgtctcctccctccaagaagtctgaaaccgacaccatcaaacgcgtcccctgcgagacaccgcccttcactcgggtcaagccgtgggcctggcacagcaccggcaacagccgctggagagacctcaagaaagcaatcccacctcactgcttcaaacgctccatccctcgctccttctcctacctcctcttcgacatcctcgtctcctcctccctctaccccctctccacagcctactcccctctcccttacctcccctgacccctctactgggcctgccaaggctgcgtcctaacgggcctctgggtcatagcccacgagtgcggccaccacgccatcagcgactac

SEQ ID NO: 43372 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 43373 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 43374 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccgtcagcgactac

SEQ ID NO: 43375 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgtagacctcaagaaagcaatcccacctcactgcttcaaacgctccatcccacgctccttctcctctccgacaacatcatctcctcctccgctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43376 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgtagagaaagcaatcccccctcactgctccaaacgctccatcccacgctccttctcctcttcgccatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43377 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcttcaaacgctccatcccacgctccttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43378 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaggacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgagtgcggccaccacgccttcagcgactac

SEQ ID NO: 43379 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43380 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 43381 - DNA, 295 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 43382 - DNA, 295 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccacctcactgcttcaaacgctccatccctcgctccttctcctacctcctcttcgacatcctcgtctcctcctccttctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43383 - DNA, 399 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacacttcactcggatggcctttttgcgtttctacaaactcttcctggctagcggtactcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43384 - DNA, 411 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccacccttcactctcggagcaggtggtggccatcgccagcaatattggtggcaagcaggcgctggagacggtgcgagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43385 - DNA, 415 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcaactatcgtcttgagtccaacccggtaagacacgacttatcgccactggcagcagccactggtaagacctcaagaaagcaatcccacctcactgcttcaaacgctccatccctcgctccttctcctacctcctcttcgacatcctcgtccccccccccccctcccacctctccacagcctacttccctctcctcccccaccctctcccttacctcgcctggcccctctactgggcctgccaaggctgcgtcctaacgagcctctgggtcatcgcccacgaatgcggccaccacgccttcagcgactac

SEQ ID NO: 43386 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 43387 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccgtcactacctcaagaaagcaatcccacctcactgcttcaaacgctcaatccctcgctccttctcctacctcctcttcgacctcctcgtctcctcctccctctaccacctctccacagcctacttccctctcccttacctcgcctgacccctctactgggcctgccaaggctgcgtcctaacgggcctctgggtcatcgcccgcgaatgcggccaccacgccttcagcgacac

SEQ ID NO: 43388 - DNA, 341 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcgacctcaagaaagcaatcccacctcactgcttcaaacgctccatccctcgccccttctcctcttcgacatcatcatctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 43389 - DNA, 308 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacactggagacggtctcgatccctcgctctttctcctacctcctcttcgacatcctcgtctcctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 43390 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaaaaggagcaattaaaggtactctctaatcctgacctgttggagtttgcttccggtctgagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43391 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcgtctgggtcatagcccacgagtgcggccaccacgccttcagcgactac

SEQ ID NO: 43392 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccaagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43393 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatcccacgctccttctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 43394 - DNA, 337 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctccatcccacgctccttctcctcttcgacatcatcatctcctcctcggctcctccctctaccacctctccatagcctacttccctctcccttacctcgcctgacccctctactgggcctgccaaggctgcgtcctaacgggcctctgggtcatagcccacgaatgcggccaccacgccttcagcgactac

SEQ ID NO: 43395 - DNA, 317 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacctcaagaaagcaatcccaccgcactgtttcaaacgctcgatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43396 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtcccctgcgagacaccaccattcactcagacctcaagaaagcaatcccacctcactgcttcaatcgctccatccctcgctccttctcctacctcctcttcgacatcctcgtctcctcctccctctaccacctctccacagcctacttccctctccccccccaccctctcccttacctcgcctggcccctctactgggcctgccaaggctgcgtcctaacgggcctctgggtcatagcccacgagtgcggccaccacgccttcagcgactac

SEQ ID NO: 43397 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 43398 - DNA, 351 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 43399 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtccgaacgggcctctgggtcatagcccacgagtgcggccaccacgccatcagcgactac

SEQ ID NO: 43400 - DNA, 350 bp, Artificial
  Mutation in BnaC.FAD2.b introduced by TALE nuclease pair BnFAD2_T03
caggatccatgggtgcaggtggaagaatgcaagtctctcctccctccagcacccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43401 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatttcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43402 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcacctcaagaaagcaatcccacctcactgcttcaaacgctccatcccacgctccttctcctcttcgacaacatcctctcctccgcgactcctccctctcccacctctccacagcctacttccctctcccttacctcgcctgacccctctactgggcctgccaaggctgcgtcctaacgggcctctgggtcatagcccacgagtgcggccaccacgccagcagcgactac

SEQ ID NO: 43403 - DNA, 349 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactgaacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 43404 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 43405 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccatcaaacgcgtcccctgcgagacaccaccattcgctcagacctcaagaaagcaatcccacctcactgcttcaaacgctccatcccacgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43406 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43407 - DNA, 466 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctggcgatggccaccacctgctccggggtcaagccgtgggcctggcacagcaccggcaacagccgctggaccgtctccagcgcctgcttgccaccattattgctggcgatgaaagacctcaagaaagcaatcccacctcactgcttcaaacgctccatccctcgctccttcccctacctccccttcgacatcctcgtctcctcctccctctaccccctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43408 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccatcccacgctccttctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43409 - DNA, 309 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 43410 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtaccctgcgagacaccgcccttcactctagaaagcaatcccacctcactgcttcaaacgctccatccctcgctccttctcctatctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43411 - DNA, 265 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatcccactctccttctcctcttcgacatcatcatctcctcctctgctcctccctctaccacctctccacagcctacttccctctcccttacctcgcctgacccctctactgggcctgccaaggctgcgtcctaactggcctctgggtcatagcccacgagtgcggccaccacgccctcagcgactac

SEQ ID NO: 43412 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccgtcagcgactac

SEQ ID NO: 43413 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcccccacgaatgcggccaccacgccttcagcgactac

SEQ ID NO: 43414 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccatcagcgactac

SEQ ID NO: 43415 - DNA, 300 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 43416 - DNA, 386 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggggtcaagccgtgtgcctggcacagcaccggcaacagccgctggaccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagccctcgagtgcggccaccacgccttcagcgactac

SEQ ID NO: 43417 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcttagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccagggctgcgtcctaaccggcgtctgggtcatagcccacgagtgcggccaccacgccttcagcgactac

SEQ ID NO: 43418 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctatccacagcctacttccctcgcctcccccaccctctcccttacctcgcctggcccctctacagggcctgccaaggctgcgtcctaacgggcctctgggtcatcgcccacgaatgcggccaccacgccgtcagcgactcc

SEQ ID NO: 43419 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattagacctcaagaaagcaatcccacctcactgcttcaaacgctccatcccacgctccttctcctcttcgacatcatcatctcctcctcggctcctacctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43420 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacaggcccacggcttgaccccccagcaggtggtggccatcgccagcaataatggtggcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgagtgcggccaccacgccttcagcgactac

SEQ ID NO: 43421 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaatcaaaaccctcaaacgcgtcccctgcgagacaccacccttcactacctcaagaaagcaatcccacctcactgcttcaaacgctccatcccccgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43422 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccgtcagcgactac

SEQ ID NO: 43423 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccaccgctccacagcctacttccctctcctccctcaccctctctcctacttcgccaggcccctctactgggcctgccaaggctgcgtcctaacgggcctctgggtcatatcctgcgagtgcggccaccacgccatcagcgactac

SEQ ID NO: 43424 - DNA, 323 bp, Artificial
  Mutation in BnaC.FAD2.b introduced by TALE nuclease pair BnFAD2_T03
caggatccatgggtgcaggtggaaggatgcaagtctctcctccctccagctcccccgaaaccaaaaccctcaaacgcgtcccctgcgagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctccccaggctccgtcctaacgggcctctgggtcatcgcccacgaatgcggcctccacgcctgcagcgactgc

SEQ ID NO: 43425 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttagacctcaagaaagcaatcccacctcactgcttcaaacgccccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccgtcagcgactac

SEQ ID NO: 43426 - DNA, 451 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagggggtcaagccgtgggcctggcacagcaccggcaacagccgctggacgaagactgggcctttcgttttatctgttgtttgtcggtgaacgctctcctgagtaggacaaatccggagacctcaagaaagcaatcccacctcactgcttcaaacgctccatcccacgctccttctcctctccgacatcatcatctcctcctcggctcctccccctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43427 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcctctgggtcatagcccacgagtgcggccaccacgccttcagcgactac

SEQ ID NO: 43428 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagaccccacccttcactctcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 43429 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttccgcgactac

SEQ ID NO: 43430 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcatacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43431 - DNA, 349 bp, Artificial
  Mutation in BnaC.FAD2.b introduced by TALE nuclease pair BnFAD2_T03
caggagccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctctctccttctcctaccccctcttcgacatcctcgtctcctcctccccctaccacctctccacagtctacttccctctccgcccccaccctctcccttaacgcgcatggcccctctactaggcctgacaaggctgcttcctaacgggcctctgggtcatcgcccacgaatgcggccaccacgccttcagcgactac

SEQ ID NO: 43432 - DNA, 351 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43433 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43434 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgtgtcctaacgggcctctgggtcatcgcccacgaatgcggccaccacgccttcagcgactac

SEQ ID NO: 43435 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctaccaaggctgcgtcctaacgggcctctgggtcatagcccacgagtgcggccaccacgccttcagcgactac

SEQ ID NO: 43436 - DNA, 426 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctccccccagcaggtggtggccatcgccagcaatggcggtggcaagcaggcgctggagacggtccagcggctgttgccgggcctgtgccaggagacctcaagaaagcaatcccacctcactgcttcaaacgctccatcccacgctccttctcctcttcgacatcatcatctcctcctcggctcctccctctcccacctccccacagcctacttccctctcccttacctcgcctgacccctctactgggcctgccaaggctgcgtcctaacgggcctctgggtcatagcccacgagtgcggccaccacgccttcagcgactac

SEQ ID NO: 43437 - DNA, 334 bp, Artificial
  Mutation in BnaC.FAD2.b introduced by TALE nuclease pair BnFAD2_T03
caggatccatgggtgcaggtggaagaatgcaagtctctcctccatccagctcccccgaaaccaaaaccctcaaacgcgtcccctgcgagacaccacccttcactcgacctcaagaaagcaatcccacctcactgcttcaaacgctccatcccacgctccttctcctcttcgacatcatcatctcctcctcggctcctgcctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43438 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccgcgagtgcggccaccacgccttcagcgactac

SEQ ID NO: 43439 - DNA, 424 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctgttgccggtgctgtgccaggcccacggcttgaccccggagcagggggtggccatcgccagccacgatggcggcaagagacctcaagaaagcaatcccacctcactgcttcaaacgctccatcccacgctccttctcctcttcgacatcatcatctcctcctccctctaccacctctccccagcctacttccctctcctcccccaccctctcccttccctcgcctgacccctctactgggcctgccaaggctgcgtcctaacgggcctctgggtcatagcccacgagtgcggccaccacgccttcagcgactac

SEQ ID NO: 43440 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43441 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagccctcgagtgcggccaacacgccttcagcgactac

SEQ ID NO: 43442 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccgcgaatgcggccaccacgccttcagcgactac

SEQ ID NO: 43443 - DNA, 340 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccacccttcactctcgggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgtcaaggctgcgtcctaacgggcctctgggtcatagcccacgagtgcggccaccacgccttcagcgactac

SEQ ID NO: 43444 - DNA, 321 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43445 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgctccaaacgctccaaccctcgctccttctcctacctcctcttcgacatcctcgtctccccccccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43446 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccaagagacctcaagaaagcaatcccacctcactgcttcaaacgctccatcccacgctccttctcctcttcgacatcatcatctcctcctcggctcctccctctaccacctctccacagcctccttccctctcccttacctcgcctggcccctctactgggcctgccaaggctgcgtcctaacgggcctctgggtcatagcccacgagtgcggccaccacgccttcagcgactac

SEQ ID NO: 43447 - DNA, 291 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43448 - DNA, 300 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagcggagacctcaagaaagcaatcccacctcactgcttcaaacgctccatcccacgctccttctcctcttcgacatcatcatctcctcctcggctcctccctcaccctctctcctacttcgcctggcctctctactgggcctgccagggctgcgtcctaaccggcgtctgggtcatagcccacgagtgcggccaccacgccttcagcgactac

SEQ ID NO: 43449 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 43450 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcgggcctggcacagaactcaagaaagcaatcccaccgcactgcttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43451 - DNA, 357 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtcggagacctcaagaaagcaatcccacctcactgcctcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43452 - DNA, 392 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggccaccacctgctggggggtcaagccgtgggcctggcacagcaccggcaacagccggagacctcaagaaagcaatcccacctcactgcttcaaacgctccatcccacgctccttctcctcctcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43453 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttaaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43454 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43455 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgctagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43456 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccctccactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43457 - DNA, 358 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggatcggagacctcaagaaagcaatcccacctcactgcttcaaacgctccatccctcgctccttctcctacctcctcttcgacattctcgtctcttcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43458 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccatcaaacgcgtcccctgcgagacaccaccattcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43459 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43460 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43461 - DNA, 313 bp, Artificial
  Mutation in BnaC.FAD2.b introduced by TALE nuclease pair BnFAD2_T03
caggatccatgggtgcaggtggaagaatgcaagtctctcctccccccagctcccccggaaccaacaccctcaaacgcgtcccctgcgagacaccaccattcactcggacctcaagaaagcaatcccacctcactgcttcaaacgctccatcccacgctccttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcagcgactac

SEQ ID NO: 43462 - DNA, 419 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttggggggtcaagccgtgggcctggcacagcaccggcaacagccgctggaccgtctccagcgcctgcttgagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 43463 - DNA, 333 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagccaacgagtgcggccaccacgccgtcagcgactac

SEQ ID NO: 43464 - DNA, 356 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccgcgagtgcggccaccacgcctgcagcgactac

SEQ ID NO: 43465 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgactcctcctccctctaccacctctccacagcctacttccctctcctcccccaccctctcccttaccacgcctggcccctcaacggggcctgccaaggctgcgtcctaacgggccgctgggtcatcgcccacgaatgcggccaccacgccatcagcgactac

SEQ ID NO: 43466 - DNA, 326 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccctcaaacgcgtcccctgcgagacaccaccattctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccctcagcgactac

SEQ ID NO: 43467 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccctcagcgactac

SEQ ID NO: 43468 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccatcagcgactac

SEQ ID NO: 43469 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccccagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 43470 - DNA, 350 bp, Artificial
  Mutation in BnaC.FAD2.b introduced by TALE nuclease pair BnFAD2_T03
caggatccatgggtgcaggtggaagaatgcaagtgtctcttccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43471 - DNA, 285 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 43472 - DNA, 334 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccattcacttgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43473 - DNA, 289 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43474 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttagacctcaagaaagcaatcccacctcactgcttcaaacgctccatccctcgctccttctcctacctcctcttcgccatcctcgtctcctcctccctctaccacctctccacatcctacttccctctcctcccccaccctctccctctcctcgcctggcccctctactgggcctgccaaggctgcgtcctaacgggcctcggggtcatcgcccacgaatgcggccaccacgccttcagcgactgc

SEQ ID NO: 43475 - DNA, 351 bp, Artificial
  Mutation in BnaC.FAD2.b introduced by TALE nuclease pair BnFAD2_T03
caggatccatgggtgcaggtggaagaatgcaagtctctcctccttccagctcccccggaaccaacaccctcaaacgcgtcccctgcgagacaccaccattcactctcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaagcctgcgtcctaacgggcctctgggtcatcgcccacgaatgcggccaccacgccttcagcgactac

SEQ ID NO: 43476 - DNA, 324 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccaccattcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43477 - DNA, 370 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgttcggctgcggcgagcggagaactcaagaaagcaatcccaccgcactgtttcaaacgctcgatccctcgctctttctcctacctcctcttcgacatcctcgtctcctcctccctctaccacctctccacagcctacttccctctccccccccaccctctcccttacctcgcctggcccctctactgggcctgccaaggctgcgtcctaacgggcctctgggtcatcgcccacgaatgcggccaccacgccttcagcgactac

SEQ ID NO: 43478 - DNA, 336 bp, Artificial
  Mutation in BnaC.FAD2.b introduced by TALE nuclease pair BnFAD2_T03
caggatccatgggtgcagttggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43479 - DNA, 280 bp, Artificial
  Mutation in BnaC.FAD2.b introduced by TALE nuclease pair BnFAD2_T03
caggatccatgggtgcaggtggaagaatgcaagtctcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 43480 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43481 - DNA, 326 bp, Artificial
  Mutation in BnaC.FAD2.b introduced by TALE nuclease pair BnFAD2_T03
caggatccatgggtgcaggtggaagaatgcaagtctctcctccctccagctccccggaaccaacaccctcaaacgcgtcccctgcgagacaccaccattcactcagacctcaagaaagcaatcccacctcactgcttcaaacgctccatcccacgctccttctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccctcagcgactac

SEQ ID NO: 43482 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcagacctcaagaaagcaatcccacctcactgcttcaaacgctcgatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43483 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 43484 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 43485 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacgacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 43486 - DNA, 334 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcatgacccctctactgggcctgccaaggctgcgtcctaacgggcctctgggtcatagcccacgagtgcggccaccacgccttcagcgactac

SEQ ID NO: 43487 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43488 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagggcggccaccacgccttcagcgactac

SEQ ID NO: 43489 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43490 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttttggagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43491 - DNA, 337 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43492 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactatttgccggtgctgtgccaggcccacggcttgaccccccagcaggtggtggccatcgccagcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctggttcatagcccacgagtgcggccaccacgccttcagcgactac

SEQ ID NO: 43493 - DNA, 411 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcaccctgaccctggaggaggtgactgatagtgacctgttcgttgcaacaaattgataagcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43494 - DNA, 441 bp, Artificial
  Mutation in BnaC.FAD2.b introduced by TALE nuclease pair BnFAD2_T03
caggatccatgggtgcaggtggaaggatgcaagtctctcctccctccagctcccccggaaccaacaccctcaaacgcgtcccctgcgagacaccacccttcactctcagcgcctgcttgccgccatcgtggctggcgatggccaccacctgctccggggtcaagccgtgggcctggcacagcaccggcaacagccgctggacggagacctcaagaaagcaatcccacctcactgcttcaaacgctccatccctcgctccttctcctacctcctctccgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43495 - DNA, 370 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttccccggagcaggtggtggccatcgccagcaatattggtggagacctcaagaaagcaatcccacctcactgcttcaaacgctccatcccacgctccttctcctcttcgacatcatcatctcctcctcggctcctacctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43496 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccgccttcagcgactac

SEQ ID NO: 43497 - DNA, 279 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 43498 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggagccaacaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43499 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcatcatctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 43500 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctactccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43501 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 43502 - DNA, 351 bp, Artificial
  Mutation in BnaC.FAD2.b introduced by TALE nuclease pair BnFAD2_T03
caggatccatgggtgcaggtggaagaatgcaagtctctcctcccaccagctcccccggaaccaacaccctcaaacgcgtcccctgcgagacaccacccttcactcggagacctcaagaaagcaatcccacctcactgcttcaaacgctccgtccctcgctccttctcctacctcctcttcgtcatcctcgtcccctcctccccctcccacctctccccagcctacttccctctcctcccccaccccctcccttacctcccctggcccctctactgggcctgccaaggctgcgtcctaacgggcctctgggtcatctcccgcgaatgtgtccaccacgccatcagcgactgc

SEQ ID NO: 43503 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcgagacctcaagaaagcaatcccaactcactgcttcaaacgctccatccctcgctccttctcctacctcctcttcgacatcctcgtctccccctccctctaccacctctccacagcctacttccctctcctcccccaccctctcccttacctcgcctggcccctctactgggcctgccaaggctgcgtcctaacgggcctctgggtcatcgcctacgaatgcggccaccacgccgtcagcgactac

SEQ ID NO: 43504 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccctggcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43505 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccaccattcactctcacctcaagaaagcaatcccacctcactgcttcaaacgctccatccctcgcgccttctcctacctcctctcccacatcctcgtctactcctccctctcccacctctccacagcctacttccctcccctcccccaccctctcccttacctcgcctggcccctctactgggcctgccaaggctgcgtcctaacgggcctctgggtcatagcccacgagtgcggccaccacgccttcagcgactac

SEQ ID NO: 43506 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 43507 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 43508 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaagacctcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43509 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactggtcctgccaaggctgcgtcctaaccggcgtctgggtcatagcccgcgagtgcggccaccacgccatcagcgactac

SEQ ID NO: 43510 - DNA, 345 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcgaactcaagaaagcaatcccaccgcactgtttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccgcgccttcagcgactac

SEQ ID NO: 43511 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43512 - DNA, 348 bp, Artificial
  Mutation in BnaC.FAD2.b introduced by TALE nuclease pair BnFAD2_T03
caggatccatgggtgcaggtggaagaatgcaagtctctcctccctccagctccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccgccctctcccttacctcgcctggcccctctactgggcctgccaagggtgcgtcctaaccggcgtctgggtcatagcccacgagtgcggccaccacgccttcagcgactac

SEQ ID NO: 43513 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacatcgcctggcccctctactgggcctgccaaggctgcgtcctaacgggcctctgggtcatcgcccacgaatgcggccaccacgccttcagcgactac

SEQ ID NO: 43514 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43515 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgaacctcaagaaagcaatcccacctcactgcttcaaacgctccatcccacgctccttctcctcttcgacatcatcatctcctcctcgcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43516 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctccattacctcgcctgacccctctactgggcctgccaaggctgcgtcctaacgggcctctgggtcagagcccacgagtgcggccaccacgccttcagcgactac

SEQ ID NO: 43517 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 43518 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccactcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 43519 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccgtcagcgactac

SEQ ID NO: 43520 - DNA, 343 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaagaaagcaatcccaccgcactgtttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 43521 - DNA, 404 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctatatgttgtgttttacagtattatgtagtctgttttttatgcaaaatctaatttaatatattgatatttatatcattttaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43522 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43523 - DNA, 336 bp, Artificial
  Mutation in BnaC.FAD2.b introduced by TALE nuclease pair BnFAD2_T03
caggatccatgggcgcaggtggaagaatgcaagtctctcctccctccagctcccccggaaccaacaccctcaaacgcgtcccctgcgagacaccaccattcactctcaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43524 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacatcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43525 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctccctcacctcgcctggcccctctactgggcctgccaaggctgcgtcctaacgggcctctgggtcatcgcccacgaatgcggccaccacgccttcagcgactac

SEQ ID NO: 43526 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcagagcccacgagtgcggccaccacgccttcagcgactac

SEQ ID NO: 43527 - DNA, 345 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgctcaagaaagcaatcccaccgcactgtttcaaacgctccatccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 43528 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43529 - DNA, 329 bp, Artificial
  Mutation in BnaC.FAD2.b introduced by TALE nuclease pair BnFAD2_T03
caggatccatgggtgcaggtggaagaatgcaagtgtctcctcactccaaaaagtctgaaaccgacaacatcaagcgcgtaccctgcgagacaccgccctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaagctgcgtcctaacgggcctcttggtcatagcccacgagtgcgtccaccacgccttcagcgactac

SEQ ID NO: 43530 - DNA, 337 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaacatcaagcgcgtaccctgcgagacaccgccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 43531 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacacctcaagaaagcaatcccacctcactgcctgaaacgctccatcccacgctccttctcctcttcgacatcatcatcccctcctcggctcctccctctaccacctctccaccgcctccttccctctcccttacctcgcctgacccctctactgggcctgccaaggctgcgtcctaacgggcgtctgggtcatagcccacgagtgcggccaccacgccttcagcgactac

SEQ ID NO: 43532 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttgacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctaccaaggctgcgtcctaacgggcctctgggtcatagcccacgagtgcggccaccacgccttcagcgactac

SEQ ID NO: 43533 - DNA, 246 bp, Artificial
  Mutation in BnaC.FAD2.b introduced by TALE nuclease pair BnFAD2_T03
caggatccatgggtgcaggtggaagaatgcaagtctctcctcccaccagctcccccgaaaccaaaaccctcaaacgcgtcccctgctagacaccacccttaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43534 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcacctgcgagacaccacccttcactctcggcttcactgcttcaaacgctccatccctcgctccttctcctacctcctcttcgacatcctcgtctcctcctccctctaccacctctccacagcctacttccatctcctcccccaccctctcccttacctcgcctggcccctctactgggcctgccaaggctgcgtcctaacgggcctctgggtcatcgcccacgaatgcggccaccacgccttcagcgactac

SEQ ID NO: 43535 - DNA, 328 bp, Artificial
  Mutation in BnaC.FAD2.b introduced by TALE nuclease pair BnFAD2_T03
caggatccagggtgcaggtggaagaatgcaagtctctcctccctccagctcccccgaaaccaaaccctcaaacgcgtcccctgcgagacaccacccttgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43536 - DNA, 305 bp, Artificial
  Mutation in BnaC.FAD2.b introduced by TALE nuclease pair BnFAD2_T03
caggatccatgggtgcaggtggaagaatgcaagtctctcctccctcaagctcccccggaaccaacaccctcaaacgcgtcccctgcgagacaccaccattcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43537 - DNA, 312 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcagcgactac

SEQ ID NO: 43538 - DNA, 359 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgaacctcaagaaagcaatcccacctcactgcttcaaacgctcgatccctcgctctttctcctacctcatctgggacatcatcatctcctcctcggctcctccctctaccacctctccacagcctacttccctctcctcccccaccctctccattacctcgcctggcccctctactgggcctgccaaggctgcgtcctaacgggcctctgggtcatcgcccacgaatgcggccaccacgccgtcagcgactac

SEQ ID NO: 43539 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttagacctcaagaaagcaatcccaccgcactgtttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43540 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcacacctcaccgcttcaaaaactccaccccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43541 - DNA, 337 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 43542 - DNA, 357 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctacctcctcttcgacatcatcatctcctcctcggctcctccctctaccacctctccacagcctacttccctctcctccctcaccctctctcctacttcgcctggcctctctactgggcctgccagggctgcgtcctaaccggcgtctgggtcatagcccacgagtgctgccaccacgccttcagcgactac

SEQ ID NO: 43543 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccaccgcactgtttcaaacgctccatccctcgctccttctcctacctcctcttcgacatcctcgtctcctcctccctctaccacctctccacagcctacttccctctcctaccccaccctctctcctacttcgcctggcctctctactgggcctgccagggctgcgtcctaaccggcgtctgggtcatagcccacgagtgcggccaccacgccttcagcgactac

SEQ ID NO: 43544 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccatcagcgactac

SEQ ID NO: 43545 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43546 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctcaagaaagcaatcccacctcactgcttcaaacgctccatccaacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43547 - DNA, 348 bp, Artificial
  Mutation in BnaC.FAD2.b introduced by TALE nuclease pair BnFAD2_T03
cagtatccatgggtgcaggtggaagaatgcaagtctctcctccctccagctcccccgaaaccaaaaccctcaaacgcgtcccctacgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43548 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacagccctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43549 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43550 - DNA, 329 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccatcagcgactac

SEQ ID NO: 43551 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcgagacctcaagaaagcaatcccacctcactgcttcaaacgctccatccctcgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43552 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 43553 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatcgcccacgaatgcggccaccacgccttcagcgactac

SEQ ID NO: 43554 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctacgagacaccacccttcactcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43555 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagggcggccaccacgccttcagcgacta

SEQ ID NO: 43556 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 43557 - DNA, 344 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaccatcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaactggcctctgggtcatcgcccacgaatgcggccaccacgccttcagcgactac

SEQ ID NO: 43558 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttagacctcaagaaagcaatcccacctcactgcttcaaacgctccatccctcgctccttctcctacctccgcttcgacgtcctcgtctcctcctccctctaccacctctccacagcctacttccctctcctcccccaccctctcccttacctcgcctggcccctctactgggccggccaaggctgcgtccgaaccggcgtcggggtcatagcccacgagtgcggccaccacgccttcagcgactac

SEQ ID NO: 43559 - DNA, 469 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcttgaccccccagcaggtggtggccatcgccagcaataatggtggcaagcaggcgctggagacggtccagcggctgttgaaccgctcgccgcagccgaacgaccgagcgcagcgagtcagtgagcgaggaagctatcccacctcactgcttcaaacgccccatcccccgctccttctcctcttcgacatcatcatctcctcctcggctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 43560 - DNA, 332 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43561 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggagaactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43562 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccacctcaagaaagcaatcccacctcactgcttcaaacgctccatccctcgctccttctcctacctcctcttcgacatcctcgtctcctcctccctctaccacctctccacagcctacttccctctcctcccccaccctctccattacctcgcctggcccctctactgggcctgccaaggctgcgtcctaacgggcctctgggtcatcgcccacgaatgcggccaccacgccttcagcgactac

SEQ ID NO: 43563 - DNA, 357 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 43564 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 43565 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaaggcggcgtcctaacgggcctctgggtcatagcccacgagtgcggccaccacgccttcagcgactac

SEQ ID NO: 43566 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccttctactgggcctgccaaggctgcgtcctaacgggcctctgggtcatagcccacgagtgcggccaccacgccttcagcgactac

SEQ ID NO: 43567 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaacctcaagaaagcaatcccacctcactgcttcaaacgctccatcccacgctccttctcctcttcgacaccatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43568 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgagacctcaagaaagcaatcccacctcactgcttcaaacgctccatccctcgctccttctcctacctcctcttcgacatcctcgtctcctcctccctctaccacctctccacagcctacttccctctccccccccaccctctcccttacctcgcctggcccctctactgggcctgccaaggctgcgtcctaacgggcctctgggtcatcgcccacgaatgcggccaccacgccttcagcgactac

SEQ ID NO: 43569 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 43570 - DNA, 280 bp, Artificial
  Mutation in BnaC.FAD2.b introduced by TALE nuclease pair BnFAD2_T03
caggatccatgggtgcaggtggaagaatgcaagtctcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 43571 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactctagacctcaagaaagcaatcccacctcactgcttcaaacgccccatcccacgctccttctcctcttcgacatcatcatctcctccacggcccctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43572 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttaactcaagaaagcaatcccacctcactgcttcaaacgctccatcccacgctccttctcctcttcgacatcatcatctcctcctcggctcctccctctaccacctctccacagcctacttccatctcccttacctcgcctgacccctctactgggcctgccaaggctgcgtcctaacgggcctctgggtcatagcccacgagtgcggccaccacgccttcagcgactac

SEQ ID NO: 43573 - DNA, 326 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgttcggctgcggcgagcggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43574 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactggtcctgccaaggctgcgtcctaacgggccgctaggtcatagcccacgagtgcggccaccacgccttcagcgactac

SEQ ID NO: 43575 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatccctcgctccttatcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 43576 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 43577 - DNA, 264 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttcgacatcctcgtctcctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 43578 - DNA, 378 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctgcgatggcggcaagcaggcgctggagaagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43579 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccatctcccttacctcgcctggcctctctactgggcctgccagggctgcgtcctaaccggcgtctgggtcatagcccacgagtgcggccaccacgccttcagcgactac

SEQ ID NO: 43580 - DNA, 342 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43581 - DNA, 346 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccatcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43582 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgacttcagcgactac

SEQ ID NO: 43583 - DNA, 366 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactatcaggggataacgcaggaaagaacatgtgagcaaaaggccagcaaatctaccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43584 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43585 - DNA, 312 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctcaccctctctcctacttcgcctggcctctctactgggcctgccaagggtgcgtcctaaccggcctctgggtcatcgcccacgaatgcggccaccacgccttcagcgacta

SEQ ID NO: 43586 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43587 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43588 - DNA, 377 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcctgcttgccaccgccattgctggcgatggccaccacctttgacctcaagaaagcaatcccacctcactgcttcaaacgctccatcccacgctccttctcctcttcgacatcatcatctcctcctcggctcctccctctaccacctctccacagcctactcccctctcccttacctcgcctgacccctctactgggcctgccaaggctgcgtcctaacgggcctctgggtcatagcccacgagtgcggcaccacgccttcagcgactac

SEQ ID NO: 43589 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacggacctctgggtcatcgcccacgaatgcggccaccacgccttcagcgactac

SEQ ID NO: 43590 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 43591 - DNA, 405 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctctgacttgagcgtcgatttttgtgatgctcgtcagggggcgccatcgccagcaatggcggcggcaggccggcgctggaacctcaagaaagcaatcccacctcactgcttcaaacgctccatcccacgctccttctcctcttcgacatcatcatctcctccgcggcccctccctctaccacctctccacagcctacttccctctcccttaccgcgcctgacccctctacggggcctgccaaggctgcgtcctaccgggcctctgggtcatagcccacgagtgcggccacctcgccttcagccgactac

SEQ ID NO: 43592 - DNA, 380 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgcgttatcccctgattctgtggataaccgtattaccgagacctcaagaaagcaatcccacctcactgcttcaaacgctccatcccacgctccttctcctcttcgacatcctcgtctcctcctccctctaccacctctccacagcctacttccctctccccccccaccctctcccttacctcgcctggcccctctactgggcctgccaaggctgcgtcctaacgggcctctgggtcatagcccacgagtgcggccaccacgccttcagcgactac

SEQ ID NO: 43593 - DNA, 413 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattccgctggaccgtctccagcgcctgcttgccaccgccattgctggcgatggccaccacctgctggggggtcaagccgtgggcctagacctcaagaaagcaatcccacctcactgcttcaaacgctccatcccacgctccttctcctcttcgacatcatcacctcctcctcggctcctccccctcccacctccccacagcctacttccctctcccttacctcgcctgacccctctactgggcctgccaaggctgcgtcctaacgggcctctgggtcatagcccacgagtgcggccaccacgccttcagcgactac

SEQ ID NO: 43594 - DNA, 347 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaccatcaagcgcgtaccctgcgagacaccgcccttcactgaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43595 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43596 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctctgggtcatagcccacgagtgcggccaccacgccttcagcgactac

SEQ ID NO: 43597 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43598 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaagggtgcgtcctaaccggcgtctgggtcatagcccacgagtgcggccaccacgccttcagcgactac

SEQ ID NO: 43599 - DNA, 301 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaacgctccatcccacgctccttctcctcttcgacatcatcatctcctcctcggctcctccctctaccacctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43600 - DNA, 316 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtagaactcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43601 - DNA, 336 bp, Artificial
  Mutation in BnaC.FAD2.b introduced by TALE nuclease pair BnFAD2_T03
caggatccatgggtgcaggtggaagaatgcaagtgtctcctccctcaagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccccctctccaaagcctacttccctctcccttacctcgcctgacccctctactgggcctgccaaggctgcgtcctaacgggcctctgggtcatagcccgcgagtgcggccaccacaccttcagcgactgc

SEQ ID NO: 43602 - DNA, 356 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggggagacctcaagaaagcaatcccacctcactgcttcaaacgctccatccctcgctccttctcctacctcctcttcgacatcctcgtctcctcctccctctaccacctctccacagcctacttccctctcctcacccaccctctcccttacctcgcctggcccctctactgggcctgccaaggctgcgtcctaacgggcctctgggtcatcgcccacgaatgcggccaccacgccttcagcgactac

SEQ ID NO: 43603 - DNA, 296 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccatcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43604 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaaagcgtcccctgcgagacaccacctcaagcaagcaatcccacctcactgcttaaaacgccccatccctcgctccttctcctacctcctcttcgacatcctcgtctcctcctccctctaccacctctccacagcctacttccctctcctcccccaccctctcccttacctcgcctgtcccctctactgggcctgccaaggctgcgtcctaacgggcctctgggtcatcgcccacgaatgcggccaccacgccttcagcgactac

SEQ ID NO: 43605 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatttactaaagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcaggactac

SEQ ID NO: 43606 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcctctctactgggcctgccagggctgcgtcctaaccggcctctgggtcatcgcccacgaatgcggccaccacgccttcagcgactac

SEQ ID NO: 43607 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 43608 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttaagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 43609 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttagcgactac

SEQ ID NO: 43610 - DNA, 316 bp, Artificial
  Mutation in BnaC.FAD2.b introduced by TALE nuclease pair BnFAD2_T03
caggatccagggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 43611 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctaccgggcctgccaaggctgcggcctaacgggcctctgggtcatcgcccacgaatgcggccaccacgccatcagcgactac

SEQ ID NO: 43612 - DNA, 378 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttttggagcagcaacgatgttacgcagcaggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43613 - DNA, 263 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43614 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaacctcaagaaagcaatcccacctcactgcttcaaacgctccatcccacgctccttctcctcttcgacctcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43615 - DNA, 308 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattagacctcaagaaagcaatcccacctcactgcttcaaacgctccatcccacgctccttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcagcgactac

SEQ ID NO: 43616 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 43617 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccatgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactaa

SEQ ID NO: 43618 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtctcctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctcttctgggcctgccaaggctgcgtcctaacgggcgtctgggtcatagcccacgagtgcggccaccacgccttcagcgactac

SEQ ID NO: 43619 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcatcatctcctcctcggctcctccctctaccacctctccacagcctacttcactctcccttacctcgcctgacccctctactgggcctgccaaggctgcgtcctaacgggcctctgggtcatcgcccacgaatgcggccaccacgccttcagcgactac

SEQ ID NO: 43620 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaccctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43621 - DNA, 369 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgaggcccacggcttgaccccggagcaggtggtggccatcgcctggcacgatggagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 43622 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcgaccaccacgccatcagcgactac

SEQ ID NO: 43623 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagcctgcgtcctaacgggcctctgggtcatagcccacgagtgcggccaccacgccttcagcgactac

SEQ ID NO: 43624 - DNA, 403 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgctggcgatggccaccacctgctggggggtcaagccgtgggcctggcacagcaccggcaacagccgcaatcccacctcactgcttcaaacgctccatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 43625 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtccgaacgggcctctgggtcatcgcccacgaatgcggccaccacgccatcagcgactac

SEQ ID NO: 43626 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43627 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacggagacctcaagaaagcaatcccacctcactgcttcaaactctccatcccacgctccttctcctcttcgacatcatcatctcctcctcgtctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43628 - DNA, 344 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaccatcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43629 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggcggcgtcctaacgggcctctgggtcatagcccacgagtgcggccaccacgccttcagcgactac

SEQ ID NO: 43630 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 43631 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgacta

SEQ ID NO: 43632 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcaagcgactac

SEQ ID NO: 43633 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgtgcctctgggtcatagcccacgagggcggccaccacgccttcagcgactac

SEQ ID NO: 43634 - DNA, 415 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcaactatcgtcttgagtccaacccggtaagacacgacttatcgccactggcagcagccactggtaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43635 - DNA, 335 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43636 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43637 - DNA, 331 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcagaactcaagaaagcaatcccaccgcactgtttcaaacgctccaccccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 43638 - DNA, 320 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43639 - DNA, 346 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43640 - DNA, 386 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttccaggcccacggcttgaccccccagcaggtggtggccatcgccagcaatggacctcaagaaagcaatcccacctcactgcttcaaacgctccatcccacgctccttctcctcttcgacatcatcatctcctcctcggctcctccctctaccccctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43641 - DNA, 397 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgccagccacgatggcggcaagcaggcgctggagacggtccagcggctgttgccggtgctgagacctcaagaaagcaatcccacctcactgcttcaaacgctccatcccacactccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 43642 - DNA, 347 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaacatcagacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43643 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtaccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43644 - DNA, 357 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtcggtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 43645 - DNA, 334 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 43646 - DNA, 317 bp, Artificial
  Mutation in BnaC.FAD2.b introduced by TALE nuclease pair BnFAD2_T03
caggatccatgggtgcaggtggaagaatgcaagtctctcctccttccagctcccccgaaaccaaaaccctcaaccgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcatcgactac

SEQ ID NO: 43647 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccgcgcctggcccctctactgggcctgccaaggctgcgtcctaacgggcctctgggtcatagcccacgagtgcggccaccacgccttcagcgactac

SEQ ID NO: 43648 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctctgggtcatagcccacgagtgcggccaccacgccttcagcgactac

SEQ ID NO: 43649 - DNA, 385 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcaaatatttcttgtcaaaaatgctccactgacgttccataaattcccagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43650 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaaacaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43651 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43652 - DNA, 334 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactagacctcaagaaagcaatcccacctcactgcttcaaacgctccatcccacgctccttctcctcttcgacatcatcatctcctcctcggctcctccctctaccacctctccagagcctacttccctctcccttacctcgcctgacccctctactgggcctgccaaggctgcgtcctaacgggcctctgggtcatagcccacgagtgcggccaccacgccttcagcgactac

SEQ ID NO: 43653 - DNA, 335 bp, Artificial
  Mutation in BnaC.FAD2.b introduced by TALE nuclease pair BnFAD2_T03
caggatccatgggtgcaggcggaagaatgcaagtgtctcctccctccaagaagtctgaaaccgacaccatcaagcgcgtaccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43654 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttcggagacctcaagaaagcaatcccacctcactgcttcaaacgctccatcccacgctccttctcctcttcgacatcatcatctcctcctctgctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43655 - DNA, 348 bp, Artificial
  Mutation in BnaC.FAD2.b introduced by TALE nuclease pair BnFAD2_T03
caggatccatgggtgcaggtggaagaatgcaagtctctcctccctcccgctcccccgaaaccaaaacactcaaccgcgtcccctgcgcgacaccacccttcactcgacctcaagaaagcaatcccacctcactgcttccaccgccccatccctcgctccttctcctacctcctctccgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcgtccaccacgccttcagcgactac

SEQ ID NO: 43656 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43657 - DNA, 420 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttggggggtcaagccgtgggcctggcacagcaccggcaacagccgctggaccgtctccagcgcctgcttgagacctcaagaaagcaatcccacctcactgcttcaaacgctccatcccacgctccttctcctcttcgacatcatcatctccccctcgccccctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 43658 - DNA, 407 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgtggacaccaaggcctactccggcggctacaacctgcccatcggccaggccgacgaagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43659 - DNA, 387 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgaccccggagcaggtggtggccatcgccagccacgatggcggcaagcaggcgacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43660 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactaagacctcaagaaagcaatcccacctcactgcttcaaacgctccatccctcgctccttctcctacctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43661 - DNA, 410 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggaagaatttgtccactacgtgaaaggcctggcacagcaccgacaacagccgctggacgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43662 - DNA, 336 bp, Artificial
  Mutation in BnaC.FAD2.b introduced by TALE nuclease pair BnFAD2_T03
caggatccatgtgtgcaggtggaagaatgcaagtgtcccctccctccaagaagtctgaaaccgacaccatcaagcgcgtaccctgcgagacaccgcccttcactggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43663 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43664 - DNA, 345 bp, Artificial
  Mutation in BnaC.FAD2.b introduced by TALE nuclease pair BnFAD2_T03
caggatccatgggtgcaggtggaagaatgcaagtatctcctccctccagctcccccgaaaccaaaaccctcaaacgcgtcccctgcgagacaccacccttcactctcggagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43665 - DNA, 393 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggtggtggccatcgccagcaatattggtggcaagcaggcgctgagacctcaagaaagcaatcccaccgcactgtttcaaacgctccatccctcgctccttctcctacctcctcttcgacatcctcgtctcctcctccctctaccccctctccacagcctacttccctctcctcccccaccctcgcccttacctcgcctgacccctctactgggcctgccaaggctgcgtcctaacgggcctctgggtcatagcccacgagtgcggccaccacgccttcagcgactac

SEQ ID NO: 43666 - DNA, 407 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggcctacaccgctgtgaagtgctccaccccgtaggtcggataaggcggttacgccttatccaacctacggagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43667 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatttcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 43668 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcacaagaaagcaatcccacctcactgcttcaaacgctccatcccacgctccttctcctcttcgacatcatcatctcctcctcggctcctccctctaccacctctccacagcctacttccctctcccttacctcgcttggcccctctactgggcctgccaaggctgcgtcctaacgggcctctgggtcatcgcccacgaatgcggccaccacgccttcagcgactac

SEQ ID NO: 43669 - DNA, 350 bp, Artificial
  Mutation in BnaC.FAD2.b introduced by TALE nuclease pair BnFAD2_T03
cagaatccatgggtgcaggtggaagaatgcaagtctctcctccctccagctcccccgaaaccaaaaccctcaaacgcgtcccctgcgagacaccaccattcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43670 - DNA, 329 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctcggaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43671 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcggcatcctcgtctcctcctccctctaccacctctccacagcctacttccctctccccccccaccctctcccttacctcgcctggcccctctactgggcctgccaaggctgcgtcctaacgggcctctgggtcatcgcccacgaatgcggccaccacgccttcagcgactac

SEQ ID NO: 43672 - DNA, 400 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagagcggatttgtcctactcaggagagcgttcaccgacaaacaacagataaaacgaaaggctcagagacctcaagaaagcaatcccacctcactgcttcaaacgctccatccctcgctccttctcctacctcctcttcgccatcctcttctcctcctccctctcccacctccccccagcctccttccctctcccttccctcgcctgacccctctactgggcctgccaaggctgcgtcctaacgggcctctgggtcatagcccacgagtgcggccaccacgccttcagcgactac

SEQ ID NO: 43673 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgaaactcaagaaagcaatcccacctcactgcttcaaacgctccatccctcgctccttctcctacctcctcttcgacatcctcgtctcctcctccctctaccacctctccaccgcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43674 - DNA, 439 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgtccagcggctgttgccggtgctgtgccaggcccacggcttgaccccggagcaggtggtggccatcgccagcaatattggtggcaagcaggcgctggcacaaagacctcaagaaagcaatcccacctcactgcttcaaacgctccatcccacgctccttctcctcttcgacatcatcatctcctccgcggctcctccctctaccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 43675 - DNA, 416 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttggccaccacctgctggggggtcaagccgtgggcctggcacgatggcggcaagcaggcgctggaggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43676 - DNA, 322 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaactggcctctgggtcatagcccacgagtgcggccaccacgccttcagcgactac

SEQ ID NO: 43677 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 43678 - DNA, 338 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcactctcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43679 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43680 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43681 - DNA, 349 bp, Artificial
  Mutation in BnaC.FAD2.b introduced by TALE nuclease pair BnFAD2_T03
caggatccatgggtgcaggcggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaagactgcgtcctaacgggcctctgggtcatagcccacgagtgcggccaccacgccttcagcgactac

SEQ ID NO: 43682 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43683 - DNA, 465 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagggggtcaagccgtgggcctggcacagcaccggcaacagccgctggacgaagactgggcctttcgtcttatctgttgtttgtcggtgaacgccctcctgagtaggacaaatccggagacctcaagaaagcaatcccaccgcactgcttcaaacgctccatccctcgctccttctcctacctcctcttcgacatcctcgtcccctcctccctctaccacctcgccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43684 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgtgcctctgggtcatcgcccacgaatgcggccaccacgccttcagcgactac

SEQ ID NO: 43685 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacatgcgacctcaagaaagcaatcccaccgcactgtttcaaactccccatcccacgccccttctcctcttcgacaccatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 43686 - DNA, 350 bp, Artificial
  Mutation in BnaC.FAD2.b introduced by TALE nuclease pair BnFAD2_T03
cagggtccatgggtgcaggtggaagaatgcaagtctctcctccctccagctcccccgaaaccaaaaccctcaaacgcgtccccacgcgtcccagcaatggcggtggcaagcaggcgctggagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43687 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctacgagacaccacccttcactcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43688 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgggaagacctcaagaaagcaatcccacctcactgcttcaaacgctccatccctcgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 43689 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctccctgcttcaaacgctccatccctcgctccttctcctacctcctcttcgacatcctcgtctcctcctccctctaccacctctccacagcctacttccctctcctcccccaccctctccctcccctcgcctggcccctctactgggcctgccaaggctgcgtcctaacgggcctctgggtcatcgcccacgaatgcggccaccacgccttcagcgactac

SEQ ID NO: 43690 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgaatgcggccaccacgccttcagcgactac

SEQ ID NO: 43691 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgggacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43692 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactccagacctcaagaaagcaatcccaccccactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 43693 - DNA, 332 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43694 - DNA, 278 bp, Artificial
  Mutation in BnaC.FAD2.b introduced by TALE nuclease pair BnFAD2_T03
catgatccatgggtgcaggtggaagaatgcaagtgtctcctccctccaagaagtctgaaaccgacaccatcaagcgcgtaccctgcgagacaccgcccttcactctcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43695 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctctcctactgcgcctggcctctctactgggcctgccaagggtgcgtcctaaccggcgtctgggtcatagcccacgagtgcggccaccacgccttcagcgactac

SEQ ID NO: 43696 - DNA, 338 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacaactcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43697 - DNA, 379 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgttcaaatccgctcccggcggatttgtcctactcaggtgaacgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43698 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgagtgcggccaccacgcctgcagcgactac

SEQ ID NO: 43699 - DNA, 393 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggtggtggccatcgccagcaatattggtggcaagcaggcgcggagacctcaagaaagcaatcccacctcactgcttcaaacgctccatccctcgctccttctcctacctcctcttcgacatcctcgtctcctcctccctctgccacctctccacagcctacttccctctcctcccccaccctctcccttacctcgcctggcccctctactgggcctgccaaggctgcgtcctaacgggcctctgggtcatctcccacgaatgcggccaccacgccttcagcgactac

SEQ ID NO: 43700 - DNA, 295 bp, Artificial
  Mutation in BnaC.FAD2.b introduced by TALE nuclease pair BnFAD2_T03
caggatccatgggtgcaggtggaagaatgcaagtctctcatccctccaggtagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 43701 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcagacctcaagaaagcaatcccacctcactgcttcaaacgctccatcccatgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 43702 - DNA, 308 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43703 - DNA, 348 bp, Artificial
  Mutation in BnaC.FAD2.b introduced by TALE nuclease pair BnFAD2_T03
caggatccatgggtgcaggtggaagaatgcaagtgtctactccctccaaaaagtctgaaaccgacaacatcaagcgcgtaccctgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 43704 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccatctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccggggctgcgtcctaaccggcctctgggtcatagcccacgagtgcggccaccacgccttcatcgactac

SEQ ID NO: 43705 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43706 - DNA, 412 bp, Artificial
  Mutation in BnaC.FAD2.b introduced by TALE nuclease pair BnFAD2_T03
caggatccatgggtgcaggtggaagaatgcaagtgtctcctcaatccaagaagtctgaaaccgacaccatcaagcgcgtaccctgcgagacaccgcccttcactgactgggcctttcgttttatctgttgtttgtcggtgaacgctctcctgagtaggacaaatccggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgcctgcagcgactac

SEQ ID NO: 43707 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctcgccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43708 - DNA, 335 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctgacgggccgctgggtcatagcccacgagtgcttccaccacgccttgagcgactac

SEQ ID NO: 43709 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactctcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43710 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43711 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43712 - DNA, 414 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcaggccgccattgctggcgatggccaccacctgctgaggggtcaagccgtgggcctggcacagcaccggcaacagccgagacctcaagaaagcaatcccacctcactgcttcaaacgctccatcccacgctccttctcctcttcgacatcatcacctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43713 - DNA, 334 bp, Artificial
  Mutation in BnaC.FAD2.b introduced by TALE nuclease pair BnFAD2_T03
caggatccatgggtgcagggggaagaatgcaagtgtctcctccctccaaaaagtctgaaaccgacaacatcaaccgcgtaccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactggacctgccaaggctgcgtcctaacgggcctctgggtcatagcccacgagggcggccaccacgccttcagcgactac

SEQ ID NO: 43714 - DNA, 318 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacaagaaagcaatcccacctcactgcttcaaacgctccatcccacgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43715 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 43716 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 43717 - DNA, 339 bp, Artificial
  Mutation in BnaC.FAD2.b introduced by TALE nuclease pair BnFAD2_T03
caggatccatgggtgcaggtggaagaatgcaagtctctcctccaccaacaccctcaaacgcgtcccctgcgagacaccaccattcactctcgggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43718 - DNA, 372 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcactctcagcggctgttgccggggctgtgccaggcccccgctcaatcccaccgcactgcttcaaacgctccatccctcgctccttctcctacctcctcttcgacatcctcgtctcctcctccctctaccacctctccacagcctacttccctctccccccccaccctctcccttacctcgcctggcccctctactgggcctgccaaggctgcgtcctaacgggcctctgggtcatcgcccacgaatgcggccaccacgccttcagcgactac

SEQ ID NO: 43719 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 43720 - DNA, 331 bp, Artificial
  Mutation in BnaC.FAD2.b introduced by TALE nuclease pair BnFAD2_T03
caggatccatgggtgcaggtggaagaatgcaagtatctcctccatcaagctcccccggaaccaacaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43721 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagataccgcccttcactgtaagaactcaagaaagcaatcccacctcactgcttcaaacgctccatccctcgctccttctcctacctcctcttcgacatcctcgtctcctcctccctctaccacctctccacagcctacttccctctcctcccccatcctctcccttacctcgcctggcccctctactgggcctgccaaggctgcgtcctaaccggcgtctgggtcatagcccacgagtgcggccaccacgccttcagcgactac

SEQ ID NO: 43722 - DNA, 406 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaaagactgggcctttcgttttatctgttgtttgtcggtgaacgctctcctgagtaggacaaatccgccggagacctcaagaaagcaatcccacctcactgcttcaaacgctccatcccacgctccttctcctcttcgacaccatcacctcctcctcgactcctccccctcccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43723 - DNA, 444 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacactcaaacgcgtcccctgcgagacaccaccattcactctctccgatttagagcttgacggggaaagccggcgaacgtggcgagaaaggaagggaagaaagcgaaaggagcgggcgctagggcgctggcaagtgtagcggttacgcgcagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgcctgcagcgactac

SEQ ID NO: 43724 - DNA, 379 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcgggttccatagcgttaaggtttcatttagcgcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43725 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43726 - DNA, 371 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtcccctgcgagacaccacccttcactctcgccggtgctgtgccaggcccagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43727 - DNA, 473 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcaaagctcgccgcgttgtttcatcaagccttaagggcgcgatcgttcaaacatttggcaataaagcgatggccaccacctgctggggggtcaagccgtgggcctggcacagcaccggcaacagagacctcaagaaagcaatcccacctcactgcttcaaacgctccatccctcgctccttctcctacctccccttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43728 - DNA, 329 bp, Artificial
  Mutation in BnaC.FAD2.b introduced by TALE nuclease pair BnFAD2_T03
caggatccatgggtgcaggtgcaagaatgcaagtctctcctccctccagctcccccggaaccaacaccctcaaacgcgtcccctgcgagacaccaccatagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43729 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43730 - DNA, 296 bp, Artificial
  Mutation in BnaC.FAD2.b introduced by TALE nuclease pair BnFAD2_T03
caggatccatgggtgcaggcggaagaatgcaagtctctcctccctccagctcccccgaaaccaaaaccctcaaacgcgtcccctgcgagacaccaccatcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43731 - DNA, 335 bp, Artificial
  Mutation in BnaC.FAD2.b introduced by TALE nuclease pair BnFAD2_T03
caggatccatgggtgcaggtgaaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctctacgacatcatcatctcctcctcggctcctccctctaccacctctccacagcctacttccctctcccttacctcgcctgacccctctactgggcctgccaaggctgcgtcctaacgggcctctgggtcatagcccacgagtgctgccaccacgccttcagcgactac

SEQ ID NO: 43732 - DNA, 350 bp, Artificial
  Mutation in BnaC.FAD2.b introduced by TALE nuclease pair BnFAD2_T03
caggatccatgggtgcaggtggaagaatgcaagtctctactcactccagctcccccggaaccaacaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaacgggcctctgggtcatagcccacgagtgcggccaccacgccttcagcgactac

SEQ ID NO: 43733 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43734 - DNA, 349 bp, Artificial
  Mutation in BnaC.FAD2.b introduced by TALE nuclease pair BnFAD2_T03
caggatccatgggtgcaggtggaagaatgcaagtcactcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43735 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccatggcggacctcaagaaagcaatcccaccttactgcttcaaacgctccatcccacgctccttctcctcttcgacatcatcatctcctcctcggctcctccctctaccacctctccacagcctacttcactctcccttacctcgcctgacccctctactgggcctgccaaggctgcgtcctaacgggcctctgggtcatagcccacgagtgcggccaccacgccttcagcgactac

SEQ ID NO: 43736 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctactcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 43737 - DNA, 347 bp, Artificial
  Mutation in BnaC.FAD2.b introduced by TALE nuclease pair BnFAD2_T03
caggatccatgggtgcaggtgcaagaatgcaagtctctcctccctccagctcccccgaaaccaaaaccctcaaacgcgtcccctgcgagccaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttgcctcgcctggcccctctactgggcctgccaaggctgcgtcctaacgggcctctgggtcatcgcccacgaatgcggccaccacgccttcagcgactac

SEQ ID NO: 43738 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggcggcgtcctaacgggcctctgggtcatagcccacgagtgcggccaccacgccttcagcgactac

SEQ ID NO: 43739 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcacctcaagaaagcaatcccacctcactgcttcaaacgctccatccctcgctccttctcctccctcctcttcgacatcctcgtctcctcctccctctaccacctctccacagcctacttccctctcctccccccccctctcccttaccccgcctggtccctctactgggcctgccaaggctgcgtcctaacgggcctctgggtcatagcccacgagtgcggccaccacgccttcacgactac

SEQ ID NO: 43740 - DNA, 343 bp, Artificial
  Mutation in BnaC.FAD2.b introduced by TALE nuclease pair BnFAD2_T03
caggatccatgggtgcaggtggaagaatgaaagtctctcctccctccagctcccccgaaaccaaaaccctcaaacgcgtcccctgcgagacaccacccttcactctagacctcaagaaagcaatcccacctcactgcttcaaacgctccatccctcgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43741 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgggaactcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 43742 - DNA, 337 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcacctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 43743 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 43744 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43745 - DNA, 348 bp, Artificial
  Mutation in BnaC.FAD2.b introduced by TALE nuclease pair BnFAD2_T03
caggatccatgggtgcaggtgaaagaatgcaagtctctcctccctccagctcccccgaaaccaaaaccctcaaacgcgtccactgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43746 - DNA, 348 bp, Artificial
  Mutation in BnaC.FAD2.b introduced by TALE nuclease pair BnFAD2_T03
caggatccatgggtgcagggtggaagaatgcaagtctctcctccctccagctcccccgaaaccaaaaccctcaaacgcgtcccctgcgagacaccacccttcactcccctcaagaaagcaatcccacctcactgcttcaaacgctccatccctcgctccttctcctacctcctcttcgacatcctcgtctcctcctccctctaccccccctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 43747 - DNA, 332 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43748 - DNA, 349 bp, Artificial
  Mutation in BnaC.FAD2.b introduced by TALE nuclease pair BnFAD2_T03
caggatccatgggtgcaggtggaagaattcaagtttctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43749 - DNA, 292 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 43750 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcctcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 43751 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 43752 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 43753 - DNA, 328 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcctctgggtcatcgcccacgaatgcggccaccacgccttcagcgactac

SEQ ID NO: 43754 - DNA, 349 bp, Artificial
  Mutation in BnaC.FAD2.b introduced by TALE nuclease pair BnFAD2_T03
caggatccatgggtgcaggtgaaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43755 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggctgccaaggctgcgtcctaacgggcctctgggtcatcgcccacgaatgcggccaccacgccttcagcgactac

SEQ ID NO: 43756 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43757 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcactgcttcaaacgctccatccctcgctccttctcctacctcctcttcgacatcctcgtctcctcctccctctaccacctctccacagcctacttccctctcctcccccaccctctcccttacctcgcctggcacctctactgggcctgccaaggctgcgtcctaacgggcctctgggtcatcgcccacgaatgcggccaccacgccttcagcgactac

SEQ ID NO: 43758 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 43759 - DNA, 425 bp, Artificial
  Mutation in BnaC.FAD2.b introduced by TALE nuclease pair BnFAD2_T03
caggatccatgggtgcaggtgaaagaatgcaagtctctcctccctccagctcccccggaaccaacaccctcaaacgcgtcccctgcgagacaccaccattcactctcggtcgttcggctgcggcgagcggtatcagctcactcaaaggcggtaatacggttatcacctgtcgcaaatatagtaaaacacttatagagacctcaagaaagcaatcccacctcactgcttcaaacgctccatcccacgctcctgctcctcttcgacaccatcaccccctcctcggctcctccctctaccgcctctccacagcctactcccctctcccttgcctcgcctgacccctctactgggcctgccaaggctgcgtcctaacgggcctctgggtcatagcccacgagtgcggccaccacgccttcagcgactac

SEQ ID NO: 43760 - DNA, 354 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctcgggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43761 - DNA, 305 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43762 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcctcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactggtcctgccaaggctgcgtcctaacgggcctctgggtcatagcccacgagtgcggccaccacgccttcagcgactac

SEQ ID NO: 43763 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtcataaaccgacaacatcaagcgcgtacccccagcaggtggtgaccatcgccagaactcaagaaagcaatcccaccgcactgtttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43764 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43765 - DNA, 288 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccacctcactgcttcaaacgctccatccctcgctccttctcctacctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 43766 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcgactcctccctctaccacctctccacagcctacttccctctcccttacctcgcctgacccctctcctgggcctgccaaggctgcgtcctaacgggcctctgggtcatagcccacgagtgcggccaccacgccttcagcgactac

SEQ ID NO: 43767 - DNA, 357 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgccggtgctgtgccaggcccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43768 - DNA, 344 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaaacgcgtcccctgcgagacaccacccttaactctcggatcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43769 - DNA, 265 bp, Artificial
  Mutation in BnaC.FAD2.b introduced by TALE nuclease pair BnFAD2_T03
caggatccatgggtgcaggtggaagaatgcaagtctctcctcattccagtctctccacctcactgcttcaaacgctccatcccacgctccttctcctcttcgacatcatcatctcctcctcggctcctccctctaccacctctccacagcctccttccctctcccttacctcgcctgacccctctactgagcctgccaaggctgcgtcctaacgggcctctgggtcatagcccacgagtgcggccaccacgccttcagcgactac

SEQ ID NO: 43770 - DNA, 349 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43771 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtgaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43772 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43773 - DNA, 410 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacacggtccagcggctgttgccggtgctgtgccaggcccacggcttgacccctcagcaggtggtggccatcgccagcaatggcggcggcaggagacctcaagaaagcaatcccacctcactgcttcaaacgctccatccctcgctccttctcctacctcctcttcgacatcctcgtctcctcctccctctaccacctctccacagcctacttccctcgcccttacctcgcctgacccctctactgggcctgccagggctgcgtcctaaccggcgtctgggtcatagcccacgagtgcggccaccacgccttcagcgactac

SEQ ID NO: 43774 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 43775 - DNA, 333 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 43776 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacaattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43777 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 43778 - DNA, 336 bp, Artificial
  Mutation in BnaC.FAD2.b introduced by TALE nuclease pair BnFAD2_T03
caggatccatgggtgcaggtgcaagaatgcaagtctctcctccctccagctcccccgaaaccaaaaccctcaaacgcgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcccttacctcccctgacccctctactgggcctgccaaggctgcgtcctaacgggcctctgggtcatagcccacgagtgcggccaccacgccttcagcgactac

SEQ ID NO: 43779 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgctagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43780 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcttcactgcttcaaacgctccatcccacgctccttctcctcttcgacatcatcatctcctcctcggctcctccctctaccacctctccacagcctacttccctctcccttacctcgcctgacccctctactgggcctgccaaggcggcgtccgaacgggcctctgggtcatagcccacgagtgcggccaccacgccatcagcgactac

SEQ ID NO: 43781 - DNA, 281 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43782 - DNA, 286 bp, Artificial
  Mutation in BnaC.FAD2.b introduced by TALE nuclease pair BnFAD2_T03
caggatccatgggtgcaggtggaagaatgcaagtccctcctccctccagctcccccgaaaccaaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 43783 - DNA, 350 bp, Artificial
  Mutation in BnaC.FAD2.b introduced by TALE nuclease pair BnFAD2_T03
caggatccatgggtgcaggtggaagaatgcaagtgtctcctacctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgtgcctctgggtcatcggccacgaatgcggccaccacgccttcagcgactac

SEQ ID NO: 43784 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgccccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43785 - DNA, 350 bp, Artificial
  Mutation in BnaC.FAD2.b introduced by TALE nuclease pair BnFAD2_T03
caggatccatgggtgcaggtggaagaatgcaagtctctcctccatccagctcccccgaaaccaaaaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 43786 - DNA, 337 bp, Artificial
  Mutation in BnaC.FAD2.b introduced by TALE nuclease pair BnFAD2_T03
caggatccatgggtgcaggcggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcgtctcctcctcggctcctccctctaccacctctccacagcctacttccctctcccttacctcgcctgacccctctactgggccggccaaggctgcgtcctaaccggcgtctgggtcatagcccacgagggcggccaccacgccttcagcgactac

SEQ ID NO: 43787 - DNA, 331 bp, Artificial
  Mutation in BnaC.FAD2.b introduced by TALE nuclease pair BnFAD2_T03
caggatccatgggtgcaggtggaagaatgcaagtctatcctccctccagctcccccgaaacccaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43788 - DNA, 336 bp, Artificial
  Mutation in BnaC.FAD2.b introduced by TALE nuclease pair BnFAD2_T03
caggatccatgggtgcaggtggaagaatgcaagtctctcctccatccagctcccccgaaaccaaaaccctcaaacgcgtcccctgcgagacaccacccttcactcgagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaaccggcgtctggttcatagcccacgattgcggccaccacgccttcagcgactac

SEQ ID NO: 43789 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaacctcaaacgcgtcccctgcgagacaccacccttcactctagacctcaagaaagcaatcccaccgcactgtttcaaacgctcgatccctcgctctttctcctacctcctcttcgacatcctcgtctcctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 43790 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43791 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgccctaacgggcctctgggtcatagcccacgagtgcggccaccacgccttcagcgactac

SEQ ID NO: 43792 - DNA, 344 bp, Artificial
  Mutation in BnaC.FAD2.b introduced by TALE nuclease pair BnFAD2_T03
caggaccatgggtgcaggtggaagaatgccagtctctcctccctccagctcccccgaaaccaaaaccctcaaacgcgtcccctgcgagacaccacccttcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43793 - DNA, 419 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctctccagcgcctgcttgccggtgctgtgccaggcccacggcttgaccccccagcaggtggtggccatcgccagcaataatggggagacctcaagaaagcaatcccacctcactgcttcaaacgctccatcccacgctccttctcctctccgacatcatcatctcctcctcggctcctccccctcccacctccccacagcctacttccctctcccttacctcgcctgacccctctactgggcctgccaaggctgcgtcctaacgggcctctgggtcatagcccacgagtgcggccaccacgccttcagcgactac

SEQ ID NO: 43794 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctagcaggcgctggagacctcaagaaagcaatcccacctcactgcttcaaacgctccatcccacgctccttctcctcttcgacatcatcatctcctcctcggctcctccctctaccacctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43795 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaagcgcgtcccctgcgagacaccacccttcactctcgacctcaagaaagcaatcccacctcactgcttcaaacgctccatccctcgctccttctcctacctcctcttcgacatcctcgtctcctcctccctctaccacctctccaccgcctacttccctctcctccccccccctctcccttccctcgcctggcctctctacggggcctgccaagggtgcgtcctaacgggcctctgggtcatagcccacgagtgcggccaccacgccttcagcgactac

SEQ ID NO: 43796 - DNA, 342 bp, Artificial
  Mutation in BnaC.FAD2.b introduced by TALE nuclease pair BnFAD2_T03
caggatccatgggtgcaggtggaagaatgcaagtgtctactccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctccccaaccctctcccttacctcgcctggcccctctactgggcctgccaaggctgcgtcctaacgggcctctgggtcatcgcccacgaatgcggccaccacgccttcagcgactac

SEQ ID NO: 43797 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcacctcaagaaagcaatcacacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctaggtcatcgcccacgaatgcggccaccacgccttcagcgactac

SEQ ID NO: 43798 - DNA, 320 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctatcccacctcactgcttcaaacgctccatcccgcgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43799 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttatcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctggcccctctactgggcctgccaaggctgcgtcctaacgggcctctgggtcatcgcccacgaatgcggccaccacgccttcagcgactac

SEQ ID NO: 43800 - DNA, 346 bp, Artificial
  Mutation in BnaC.FAD2.b introduced by TALE nuclease pair BnFAD2_T03
caggatctatgggtgcaggtggaagaatgcaagtctctcctcccttcagctcccccgaaaccaaaaccctcaaacgtgtcccctgtgagacaccacccttcactctgtagagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgtgtcatcgcccacgaatgcgtccaccacgccttcagcgactac

SEQ ID NO: 43801 - DNA, 332 bp, Artificial
  Mutation in BnaC.FAD2.b introduced by TALE nuclease pair BnFAD2_T03
caggatccatgggtgcaggtggaagaatgcaagtctctcctccctccaactaccccgaaaccgacaccatcaagcgcgtcccctgcgagacaccgcccttcactgacctcaagcacgcgaaaccaactccctccttctaacgcacactccctcgctccttctccttcctcctcttcgtctgcctcgtctcctcctccccctgctacctctccctcgcctccctccctctcccttacctcgcctggcccctctactgggcctgccaaggctgcgtcctaaccggcctctgggtcatagcccacgagtgcggccaccacgccttcagcgactac

SEQ ID NO: 43802 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctccattacctcgcctggcccctctactgggcctgccaaggctgcgtcctaacgggcctctgggtcatcgcccacgaatgcggccaccacgccttcagcgactac

SEQ ID NO: 43803 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43804 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcgtctcctcctccctctaccacctctccacagcctacttccctctcctcccccaccctctcccttaccccgcctggcccctctactgggcctgccaaggctgcgtcctaacgggcctctgggtcatcgcccacgaatgcggccaccacgccttcagcgactac

SEQ ID NO: 43805 - DNA, 296 bp, Artificial
  Mutation in BnaC.FAD2.b introduced by TALE nuclease pair BnFAD2_T03
caggatccatgggtgcaggtggaagaatgcaagtctctcatccctccaggtagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgtcttcagcgactac

SEQ ID NO: 43806 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcatgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43807 - DNA, 308 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43808 - DNA, 334 bp, Artificial
  Mutation in BnaC.FAD2.b introduced by TALE nuclease pair BnFAD2_T03
caggatccatgggtgcaggtgcaagaatgcaagtgtctcctccctccagctcccccggaaccaacaccctcaaacgcgtcccctgcgagacaccaccgttcactagacctcaagaaagcaatcccacctcactgcttcaaacgctccatcccacgctccttctcctcttcgccaccatcatctcctcctcggctcctccctctaccacctctccacagcctacttccctctcccttacctcgcctgacccctctacggggcctgccaaggctgcggcctaacgggcctctgggtcatagcccacgagtgcggccaccacgccttcagcgactac

SEQ ID NO: 43809 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcacacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 43810 - DNA, 323 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43811 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43812 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacccctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43813 - DNA, 341 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcacaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 43814 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgtgcctctgggtcatagcccacgagtgcggccaccacgccttcagcgactac

SEQ ID NO: 43815 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43816 - DNA, 402 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttggccaccacctgctggggggtcaagccgtgggcctggcacgatggcggcaagcaggcgctggaggagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaagggtgcgtcctaacgggcctctgggtcatagcccacgagtgcggccaccacgccttcagcgactac

SEQ ID NO: 43817 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctctcctacttcgcctggcctctctactgggcctgccagggctgcgtcctaaccggcgtctgggtcatagcccacgagtgcggccaccacgccttcagcgacta

SEQ ID NO: 43818 - DNA, 428 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccgtccagcggctgttgccggtgctgtgccaggcccacggcttgaccccggagcaggtggtggccatcgccagccacgatggcggcaagcaggcgctggagagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43819 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccaccgcactgtttcaaacgcccgatcccacgctccttctcctcttcgacatcatcatctcctcctcgcctcctccctctaccacctctccacagcctacttccctctcctcccccaccctctcccttacctcgcctgacccctctactgggcctgccagggctgcgtcctaaccggcgtctgggtcatagcccacgagtgcggccaccacgccttcagcgactac

SEQ ID NO: 43820 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43821 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcgagacctcaagaaagcaatcccacctcactgcttcaaacgctccatcccacgctccttcacctcttcgacatcatcatctcctcctcggctcctccctctaccacctctccacagcctacttccctctcccttacctcgcctgacccctctaccgggcctgccaaggctgcgtcctaacgggcctctgggtcatagcccacgagtgcggccaccacgccttcagcgactac

SEQ ID NO: 43822 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 43823 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggatgcgtcctaaccggcgtctgggtcatagcccacgagtgcggccaccacgccttcagcgactac

SEQ ID NO: 43824 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaatgcgtcccctgtagacctcaagaaagcaatcccaccgcactgtttcaaacgctcgatccctcgctctttctcctacctcatctgggacatcatcatagcctcctgcttctactacgtcgccaccacttacttccctctcatcccccaccctctcccttacctcgcctggcccctctactgggcctgccaaggctgcgtcctaacgggcctctgggtcatcgcccacgaatgcggccaccacgccttcagcgactac

SEQ ID NO: 43825 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgttccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 43826 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcctccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43827 - DNA, 342 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 43828 - DNA, 314 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctcaccctctctcctacttcgcctggcctctctactgggcctgccaagggtacgtcctaaccggcgtctgggtcatagcccacgagtgcggccaccacgccttcagcgactac

SEQ ID NO: 43829 - DNA, 411 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgccagcaataatggtggcaagcaggcgctggagacggtccagcggctgttgccggtgctgagacctcaagaaagcaatcccacctcactgcttcaaacgctccatccctcgctccttctcctacctcctcttcgacatcctcgtctcctcccccctctaccacctctccacagcctacttccctctcctcccccaccctctcccttacctcgcctggcccctctactgggcctgtcaaggctgcgtcctaacgggcctctgggtcatagcccacgagtgcggccaccacgccttcagcgactac

SEQ ID NO: 43830 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacccctccccagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43831 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcgagacctcaagaaagcaatcccacctcactgcttcaaacgctccatcccacgctccttctcctcttcgacatcatcatctcctcctcggctcctccatctaccacctctccacagcctacttccctctcccttacctcgcctgacccctctactgggccggccaaggctgcgtcctaacgggcctctgggtcatagcccacgagtgcggccaccacgccttcagcgactac

SEQ ID NO: 43832 - DNA, 347 bp, Artificial
  Mutation in BnaC.FAD2.b introduced by TALE nuclease pair BnFAD2_T03
caggatccatgggtgcaggtggaagaatgcaagtatctcctccttcccgctcccccggacccaacaccctcaaacgcgtcccctgcgagacaccaccattcactaacctcaagaaagcaatcccacctcactgcttcaaacgctccatcccacgctccttctcctcttcgacatcatcatctcctcctcggctcctccctctaccacctctccacagcctacttccctctcctccccaccctctcccttacctcgcctggcccctctactggtcctgccaaggctgcgtcctaacgggcctctgggtcatcgcccacgaattcgtccaccacgccttcagcgactac

SEQ ID NO: 43833 - DNA, 326 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtacggctgcggcgagcggagaactcaagaaagcaatcccaccgcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43834 - DNA, 401 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggagacggtccagcggctgttgccggtgctgtgccaggcccacggtccagcgcctgcttgccggagacctcaagaaagcaatcccacctcactgcttcaaacgctccatcccacgctccttctcctcttcgacatcatcatctcctcctcggctcctccctctaccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 43835 - DNA, 346 bp, Artificial
  Mutation in BnaC.FAD2.b introduced by TALE nuclease pair BnFAD2_T03
caggatccatgggtgcaggtggaagaatgcaagtctctcctctctccagctcccccggaaccaacaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggggcgtccgaaccggcgtctgggtcatagcccacgagtgcggccaccacgccttcagcgactac

SEQ ID NO: 43836 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactgacctcaagaaagcaatcccacctcactgcttcaaacgctccatccctcgctccttctcctacctcctcttcgacatcctcgtctcctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 43837 - DNA, 321 bp, Artificial
  Mutation in BnaC.FAD2.b introduced by TALE nuclease pair BnFAD2_T03
caggatccatgggtgcaggtggaagaatgcaagtgtctcctccctccaactcccccggaaccaacaccctcaaacgcgtcccctgcgagacaccaccataaaaagcaatcgcacctcactgcgtcaaacgctccatcccacgctccttctcctcttcgacatcatcatctcctcctctactccgccccctcccacctctccacatcctactaccctctcccttacctcgcctggcccctctactgggcctgccaaggctgcgtcctaacgggcgtctgggtaatagcccacgagtgcggccaccacgccttcagcgactac

SEQ ID NO: 43838 - DNA, 345 bp, Artificial
  Mutation in BnaC.FAD2.b introduced by TALE nuclease pair BnFAD2_T03
caggatccatgggtgcaggtggaagaatgcaagtatctcctccctccagctcccccgaaaccaaaaccctcaaacgcgtcccctgcgagacaccacccttcacccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43839 - DNA, 403 bp, Artificial
  Mutation in BnaC.FAD2.b introduced by TALE nuclease pair BnFAD2_T03
caggatccattggtgcaggtggaagaatgcaagtctctcctccctccagctcccccgaaaccaaaaccctcaaacgcgtcccctgcgagacaccacccttcactcttgctggcgatggccaccacctgctggggggtcaagccgtgggcctggcacagcaccggcaacagccgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43840 - DNA, 411 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagccgaacgaccgagcgcagcgagtcagtgagcgaggaagcggaagagcgcccaatacgcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43841 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactacttcaaacgctccatcccacgctccttctcctcttcgacatcatcatctcctcctcgcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43842 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgtgtcatcgcccacgaatgcggccaccacgccttcagcgactac

SEQ ID NO: 43843 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagaccccacccttcactcagacctcaagaaagcaatcccacctcactgcttcaaacgctccatcccactctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 43844 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43845 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgtaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 43846 - DNA, 346 bp, Artificial
  Mutation in BnaC.FAD2.b introduced by TALE nuclease pair BnFAD2_T03
caggatccatgggtgcaggtggaagaatgcaagtctctcttccctccagctcccccgaaaccaaaaccctcaaacgcgtcccctgcgagacaccacccttcaagacctcaagaaagcaatcccacctcactgcttcaaacgctccatccctctctccttctcctacctcctcttcgacatcctcgtctcctcctccctctaccacctctccacagcctacttccctctcctcccccaccctctcccttacctcgcctggcccctctactgggcctgccaaggctgcgtcctcacgggcctctgtgtcatcgcccacgaatgctgccaccacgccttcagcgactac

SEQ ID NO: 43847 - DNA, 346 bp, Artificial
  Mutation in BnaC.FAD2.b introduced by TALE nuclease pair BnFAD2_T03
caggatccatgggtgcaggtggaagaatgcaagtgtctcctccctccaagaagtctgataccgacaccatcaagcgcgtaccctgcgagacaccgcccttcactacctcaagaaagcaatcccacctcactgcttcaaacgctccatccctcgctccttctcctacctcctcttcgacatcctcgtctcctcctccctctaccacctctccacagcctacttccctctcctccctcaccctctcccttacctcgcctggcccctctactgggcctgccaaggctgcgtcctaacgggcctctgggtcatagcccacgagtgcggccaccacgccttcagcgactac

SEQ ID NO: 43848 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgctaaggctgcgtcctaacgggtctctgggtcatcgcccacgaatgcggccaccacgccttcagcgactac

SEQ ID NO: 43849 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaacgctccatcccacgctccttctcctcttcgacatcatcctctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43850 - DNA, 332 bp, Artificial
  Mutation in BnaC.FAD2.b introduced by TALE nuclease pair BnFAD2_T03
caggatccatgggtgaggtggaagaatgcaagtatctcctccctccaagaagtctgaaaccgacaccatcaagcgcgtaccctgcgagacaccgcccttcactgaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgctgccaccacgccttcagcgactac

SEQ ID NO: 43851 - DNA, 352 bp, Artificial
  Mutation in BnaC.FAD2.b introduced by TALE nuclease pair BnFAD2_T03
caggatccatgggtgcaggtggaagaatgcaagtctcccctccctccagctcccccgaaaccaaaaccctcaaacgcgtcccctgcgagacaccacccttcactctagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43852 - DNA, 309 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcctcctccacgcctttagcgactac

SEQ ID NO: 43853 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaaacgcgtcccctgttatcgagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43854 - DNA, 351 bp, Artificial
  Mutation in BnaC.FAD2.b introduced by TALE nuclease pair BnFAD2_T03
caggatccatgggtgcaggtggaagaatgcaagtctctcctccctcccgctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43855 - DNA, 342 bp, Artificial
  Mutation in BnaC.FAD2.b introduced by TALE nuclease pair BnFAD2_T03
caggatccatgggtgcaggtgaaagaatgcaagtgtcaactccctccagctcccccgaaaccaaaacactaaaacgcgtcccctgcgagacaccacccttcactcaagaaagcaatcccacctcactgcttcaaacgctccatccctcgctccttctcctacctcctcttcgacatcctcgtctcctcctccctccaccacctctccacagcctacttccctctcctcccccaccctctcccttacctcgcctggcccctctactgggcctgccaaggcggcgtcctaacgggcctctgggtcatcgcccacgaatgcgtccaccacgccttcagcgactac

SEQ ID NO: 43856 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctccttctcctacctcctcttcgacatcctcgtcacctcctccctctaccacctctccacagcctacttccctctcctcccccaccctctccctgacctcgcctggcccctctactgggcctgccaaggctgcgtcctaacgggcctctgggtcatcgcccacgaatgcggccaccacgccttcagcgactac

SEQ ID NO: 43857 - DNA, 357 bp, Artificial
  Mutation in BnaC.FAD2.b introduced by TALE nuclease pair BnFAD2_T03
caggatccatgggtgcaggtggaagaatgcaagtctctcctccatccagctcccccgaaaccaaaaccctcaaacgcgtcccctgcgagacaccacccttcactctcggcctttttacggttcctctccctcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 43858 - DNA, 331 bp, Artificial
  Mutation in BnaC.FAD2.b introduced by TALE nuclease pair BnFAD2_T03
caggatccatgggtgcaggtggaagaatgcaagtctctcctcactccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 43859 - DNA, 333 bp, Artificial
  Mutation in BnaC.FAD2.b introduced by TALE nuclease pair BnFAD2_T03
caggatccatgggtgcaggtggaagaatgcaagtatctcctcactccagctcccccgaaaccaaaaccctcaaacgcgtcccctgcgagacaccacccttcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 43860 - DNA, 349 bp, Artificial
  Mutation in BnaC.FAD2.b introduced by TALE nuclease pair BnFAD2_T03
caggatccatgggtgcaggtgaaagaatgcaagtgtctcctctctcaagctcccccgaaaccaaaaccctcaaacgcgtcccctgcgagacaccacccttcactcgacctcaagaaagcaatcccacctcactgcttcaaacgctccatcccacgctccttctcctcttcgacctcatcatctcctcctcggctcctccctctaccacctctccacagcctacttccctctcctcccccaccctctcccttacctcgcctggcccctctactgggcctgccatggctgcgtcctgacgggcctctgggtcatcgcccgcgaatgctgccaccacgccttcaacgactac

SEQ ID NO: 43861 - DNA, 352 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaactcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43862 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggacaccacgccttcagcgactac

SEQ ID NO: 43863 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccattcactggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43864 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43865 - DNA, 337 bp, Artificial
  Mutation in BnaC.FAD2.b introduced by TALE nuclease pair BnFAD2_T03
caggatccatgggtgcaggtggaagaatgcaagtctcccctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43866 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 43867 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaggggaagccgaagtttccaaaaggtcgttgatcaaagctcgccgcgttgtttcatcggagacctcaagaaaacaatcccacctcactgcttcaaacgctccatcccacgctccttctcctcttcgacatcatcatctcctcctcggctcctccccctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43868 - DNA, 332 bp, Artificial
  Mutation in BnaC.FAD2.b introduced by TALE nuclease pair BnFAD2_T03
caggatccatgtgcaggtggaagaatgcaagtctctcctccctccagctcccccggaaccaacaccctcaaacgcgtcccctgcgagacaccaccattcactcagacctcaagaaagcaatcccaccgcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43869 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcacggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43870 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43871 - DNA, 420 bp, Artificial
  Mutation in BnaC.FAD2.b introduced by TALE nuclease pair BnFAD2_T03
caggatccattggtgcaggtggaagaatgcaagtctctcctccctccagctcccccggaaccaacaccctcaaacgcgtcccctgcgagacaccaccattcactctcggtgttgtgccaggcccacggcttgaccccggagcaggtggtggccatcgccagccacgatggcggcaacagccgctggacccagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43872 - DNA, 337 bp, Artificial
  Mutation in BnaC.FAD2.b introduced by TALE nuclease pair BnFAD2_T03
caggatccatgtgtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccaaagcctacttccctctcccttacctcgcctgacccctctactgggcctgccaaggctgcgtcctaaccggcgtctgggtcatagcccacgagtgcggccaccacgccttcagcgactac

SEQ ID NO: 43873 - DNA, 328 bp, Artificial
  Mutation in BnaC.FAD2.b introduced by TALE nuclease pair BnFAD2_T03
caggatccatgggtgcaggtggaagaatgcaagtttctcctccctccagctcccccggaaccaacaccctcaaacgcgtcccctgcgagacaccaccattcactcaagaaagcaatcccacctcactgcttcaaacgctccatcccacgctccttctcctcttcgacatcatcatctcctcctcggctcctccctctaccacctctccacagcctccttccctctcccttacctcgcctgacccctctactgggcctgccaaggctgcggcctaacgggcctctgggtcatagcccacgagtgcggccaccacgccttcagcgactac

SEQ ID NO: 43874 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctccgggtcatagcccacgagtgcggcgaccacgccttcagcgactac

SEQ ID NO: 43875 - DNA, 335 bp, Artificial
  Mutation in BnaC.FAD2.b introduced by TALE nuclease pair BnFAD2_T03
caggatccatgggtgcaggtgaaagaatgcaagtctctcctccctcaagctcccccgaaaccaaaacactaaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctcccaaggctgcttcctgacgggcctctgggtcatagcccgcgagtgcggccaccacgccttcagcgactac

SEQ ID NO: 43876 - DNA, 331 bp, Artificial
  Mutation in BnaC.FAD2.b introduced by TALE nuclease pair BnFAD2_T03
cacatgggtgcaggtggaagaatgcaagtctctcctccctccagctcccccggaaccaacaccctcaaacgcgtcccctgcgagacaccaccattcactcatgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43877 - DNA, 347 bp, Artificial
  Mutation in BnaC.FAD2.b introduced by TALE nuclease pair BnFAD2_T03
caggatccatgggtgcaggtggaagaatgcaagtgtctcctccatccaaaaagtctgaaaccgacaccatcaagcgcgtaccctgcgagacaccgcccttcactgaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 43878 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcaagaaagcaatcccacctcactgcttcaaacgctccatccctcgctccttctcctacctcctcttcgacatcctcgtctcctcctccctctaccacctctccacagcctacttcctctcctccctcaccctctctcctacttcgcctggcctctctactgggcctgccaagggtgcgtcctaacgggcctctgggtcatcgccgacgaatgcggccaccacgccttcagcgactac

SEQ ID NO: 43879 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 43880 - DNA, 316 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaactcctccctcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43881 - DNA, 256 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccaccattcactctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactc

SEQ ID NO: 43882 - DNA, 469 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacaaacaacagataaaacgaaaggcccagtctaccgctcgccgcagccgaacgaccgagcgcaagtcagaggtggcgaaacccgacaggactataaagataccaggcgtttccccctggaagctccctcggagacctcaagaaaccaatcccacctcactgcttcaaacgccccatcccaccccccttcccctctccgacatcatcacctcctcctcggctcctccctctcccacctcgccacagcctacttccctctcccttacctcgcctgacccctctactgggcctgccaaggctgcgtcctaacgggcctctgggtcatagcccacgagtgcggccaccacgccttcagcgactac

SEQ ID NO: 43883 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 43884 - DNA, 394 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacattgaatcctgttgccggtcttgcgggactctaatcataaaaacccatctcataaataacgtagacctcaagaaagcaatcccacctcactgcttcaaacgctccatccctcgctccttctcctacctcctcttcgacatcctcgtctcctcctccctctcccacctccccacagcctccttccctctcccttccctcgcctgacccctctactgggcctgccaaggctgcgtcctaacgggcctctgggtcatagcccacgagtgcggccaccacgccttcagcgactac

SEQ ID NO: 43885 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43886 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 43887 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 43888 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgaatgcggccaccacgccttcagcgactac

SEQ ID NO: 43889 - DNA, 295 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccacctcactgcttcaaacgctccatccctcgctccttctcctacctcctcttcgacatcctggtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43890 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcatcaaacgctccatcccacgctccttctcctcttcgacatcatcatctcctcctcggctactccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43891 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43892 - DNA, 349 bp, Artificial
  Mutation in BnaC.FAD2.b introduced by TALE nuclease pair BnFAD2_T03
caggatccatgggtgcagggggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43893 - DNA, 279 bp, Artificial
  Mutation in BnaC.FAD2.b introduced by TALE nuclease pair BnFAD2_T03
caggatccatgggtgcaggtggaagaatgcaagtctctcctccctccagtctctccacctcactgcttcaaacgctccatccctcgctccttctcctacctcctcttcgacatcctcgtctcctcctccctctaccacctctccacagcctacttccctctcctcccccaccctctcccttacctcgcctggcccctctacttggcctgccaaggctgcgtcctaacgggcctctgggtcatcgcccacgaatgcggccaccacgccttcagcgactac

SEQ ID NO: 43894 - DNA, 336 bp, Artificial
  Mutation in BnaC.FAD2.b introduced by TALE nuclease pair BnFAD2_T03
caggatccatgggtgcaggtggaagaatgcaagtctctcctccctcaagctcccccggaaccaacaccctcaaacgcgtcccctgcgagacaccaccattcactctagacctcaagaaagcaatcccacctcactgcttcaaacgctccatcccacgctccttctcctcttcgccatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43895 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 43896 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43897 - DNA, 331 bp, Artificial
  Mutation in BnaC.FAD2.b introduced by TALE nuclease pair BnFAD2_T03
caggatccatgggtgcaggtggaagaatgcaagtctctcctccctccagctccccagaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccacaacgccttcagcgactac

SEQ ID NO: 43898 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43899 - DNA, 320 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43900 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43901 - DNA, 349 bp, Artificial
  Mutation in BnaC.FAD2.b introduced by TALE nuclease pair BnFAD2_T03
caggatccatgggtgcaggtggaagaatgcaagtctctcctcctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43902 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccaccgcactgttccaaacgctcgatccctcgctctttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 43903 - DNA, 337 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccacctcactgcttcaaacgctccatcccacgctccttctcctcttcgacatcatcatctcctcatcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43904 - DNA, 422 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcacggtgtgcgtcacccggcaaccttgggtagcacaagcaggcgctggagacggtccagcggctgttgccggagacctcaagaaagcaatcccacctcactgcttcaaacgctccatccctcgctccttctcctacctcctcttcgacatcctcgtctcctcctccctctaccacctctccacagcctacttccctctccgccccccccctctcccttacctcgcctgacccctctactgggcctgccaaggctgcgtcctaacgggcctctgggtcatagcccacgagtgcggccaccacgccttcagcgactac

SEQ ID NO: 43905 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactggtcctgccaaggctgcgtcctaacgtgcctctgggtcatcgcccacgaatgcggccaccacgccttcagcgactac

SEQ ID NO: 43906 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccactcaagaaagcaatcccacctcactgcttcaaacgctccatcccacgctccttctcctcttcgacatcatcatctcctcctcggctcctccctctaccacctctccacatcctacttccctctcctccctccccctctctcctacttcgcctggcctctctactgggcctgcaatgggtgcgtcctaaccggcgtctgggtcatagcccacgagtgcggcctccacgccttcagcgactac

SEQ ID NO: 43907 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactacctcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43908 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43909 - DNA, 337 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccatcaaacgcgtcccctgcgagacaccacccttaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43910 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcccacctcactgcttcaaacgctccatcccacgctccttctcctcttcgacatcatcatctcctcctcggctcctccctctaccacctctccacagcctacttccctctcctccctcaccctctctcatacttcgcctggcctctctactgggcctgccaagggtgcgtcctaaccggcgtctgggtcatagcccacgagtgcggccaccacgccttcagcgactac

SEQ ID NO: 43911 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43912 - DNA, 423 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacttcgctgctacccaaggttgccccacgagtacatcgagctgatcgagatcgcccggaacagcacccaagagacctcaagaaagcaatcccacctcactgcttcaaacgctccatccctcgctccttctcctacctcctcttcgacatcctcgtctcctcctccctccaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43913 - DNA, 350 bp, Artificial
  Mutation in BnaC.FAD2.b introduced by TALE nuclease pair BnFAD2_T03
caggatccatgagtgcaggtggaagaatgcaagtctctcctccctccagctcccccgaaaccaaaaccctcaaacgcgtcccctgcgagacaccacccttcactcgagacctcaagaaagcaatcccacctcactgcttcacacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43914 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccatctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43915 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccctacctcgcctggcctctctactgggcctgccaagggtgcgtcctaaccggcgtctgggtcatagcccacgagtgcggccaccacgccttcagcgactac

SEQ ID NO: 43916 - DNA, 335 bp, Artificial
  Mutation in BnaC.FAD2.b introduced by TALE nuclease pair BnFAD2_T03
caggatccatgggtgcaggtggaagaatgcaagtatctactccctccagctcccccggaaccaacaccctcaaacgcgtcccctgcgagacaccaccattcactctcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43917 - DNA, 379 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctggtggtggccatcgccagcaatattggtggcaagcaggcgctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43918 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcttacagcgagcgatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43919 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcttcaaacgctccatcccacgctccttctcctcttcgacatcatcatctcctcctcggctcctccctctaccacctctccacaacctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 43920 - DNA, 295 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccacctcactgcttcaaacgctccatccctcgctccttctcctacctcatctgggacatcatcatagcctcctgcttctactacgtcgccaccacttacttccctctcctcccccaccctctcccttacctcgcctggcctctctactgggcctgccaaggctgcgtcctaacgggcctctgggtcatagcccacgagtgcggccaccacgccttcagcgactac

SEQ ID NO: 43921 - DNA, 348 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcacaagacctcaagaaagcaatcccacctcactgcttcaaacgctccatccctcgctccttctcctacctactattcgacatcctcgtctcctcctccctctaccacctctccacagcctacttccctctcctcccccaccctctctcctacttcgcctggcctctctactgggcctgccaaggctgcgtcctaacgggcctctgggtcatagcccacgagtgcggccaccacgccttcagcgactac

SEQ ID NO: 43922 - DNA, 412 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggctgttgccggtgctgtgccaggcccacggcttgaccccggagcaggtggtggccatcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43923 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 43924 - DNA, 397 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggatcagggcgagataactgggcaacaatgctctccagcgccggcctgccgccgccattgagacctcaagaaagcaatcccacctcactgcttcaaacgctccatcccacgctccttctcctcttcgacatcatcatctcctcctcggctcctccctctaccacctctccacagcctactgccctctcccttacctcgcctgacccctctactgggcctgccaaggctgcgtcctaacgggcgtctgggtcatagcccacgagtgcggccaccacgccttcagcgactac

SEQ ID NO: 43925 - DNA, 333 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43926 - DNA, 381 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacggtccagcggctgttgccggtgctgtgccaggcccacggcttgaccccggagcaggtggtggccagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatcgcccacgaatgcggccaccacgccttcagcgaac

SEQ ID NO: 43927 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43928 - DNA, 335 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 43929 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctccttctcctacctcctcttcgccatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43930 - DNA, 334 bp, Artificial
  Mutation in BnaC.FAD2.b introduced by TALE nuclease pair BnFAD2_T03
caggatccatgggtgcagtggaagaatgcaagtctctcctccctccagctcccccggaaccaacaccctcaaacgcgtcccctgcgagacaccaccattcactctcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43931 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactcttagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43932 - DNA, 431 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttggcggcaagcaggcgctggagacggtccagcggctgttgccggtgctgtgccaggcccacggcactaccccggagcaggtggtggccattgccggagacctcaagaaagcaatcccacctcactgcttcaaacgctccatcccacgctccttctcctacctcctcttcgacatcctcgtctcctcctccctctcccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 43933 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcagcggatttgtcctactcaggagagcgttcaccgacaaacaacagataaaacgaaaggcccagtcttccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43934 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgcttcaaacgctccatcccacgctccttctcctcttcgacatcatcatctcctcctcggctcctccctctaccacctctccacaccctacttccctctcccttacctcgcctggcccctctactgggcctgccaaggctgcgtcctaacgggcctctgggtcatcgcccacgaatgcggccaccacgccttcagcgactac

SEQ ID NO: 43935 - DNA, 335 bp, Artificial
  Mutation in BnaC.FAD2.b introduced by TALE nuclease pair BnFAD2_T03
caggatccatgggtgcaggtggaagaatgcaagtttctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaagggcctctgggtcatcgcccacgaatgcggccaccacgccttcagcgactac

SEQ ID NO: 43936 - DNA, 356 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43937 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 43938 - DNA, 337 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtcccctgcgagacaccaccattcactctaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43939 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccattcactagacctcaagaaagcaatcccacctcactgcttcaaacgctccatccctcgctccttctcctcttcgacatcatcatctcctcctcggctccgccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43940 - DNA, 417 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctgttgccggtgctgtgccaggcccacggcttgaccccggagcaggtggtggccatccccagctacgatggcggcaagagacctcaagaaagcaatcccacctcactgcttcaaacgctccatcccacgctccttctcctcttcgacatcatcatcccctcctcggctcctccctctcccacctccccacagcctacttccctctcccttccctcgcctaacccctctactgggcctgccaaggctgcgtcctaacgggcctctgggtcatagcccacgagtgcggccaccacgccttcagcgactac

SEQ ID NO: 43941 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagcaagcaatcccacctcactgcttcaaactctccatccctagctccttctcctacctcctcttcgccatcctcgactcctcctccctctaccgcctctccacagcctacttccctctcctccccctccctctcccttacctcgcctggcccctctactgggcctgccaaggctgcgtcctaacgggcctctgggtcatcgcccacgaatgcggccaccacgccttcagcgactac

SEQ ID NO: 43942 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgagtgcggccaccacgccttcagcgactac

SEQ ID NO: 43943 - DNA, 307 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43944 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcagacctcaagaaagcaatcccaccgcactgtttcaaacgctcgatccctcgctctttctcctcttcgacatcatcatctcctcctcggctcctccctctaccacctctccacagcctacttccctctcccttacctcgcctggcctctctactgggccggccagggctgcgtcctaacgggcctttggtcatcgcccacgaatgcggccaccacgccttcagcgactac

SEQ ID NO: 43945 - DNA, 362 bp, Artificial
  Mutation in BnaC.FAD2.b introduced by TALE nuclease pair BnFAD2_T03
caggatccatgggtgcaggtggaagaatgcaagtctctcctccctccagctccccaggaaccaacaccctcaaacgcgtcccctgcgagacaccaccattcactcaatggcggtggcaagcaggcgctggagagacctcaagaaagcaatcccacctcactgcttcagacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43946 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 43947 - DNA, 400 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccccgcgagacaccacccttcactctcggcttgaccccccagcaggtggtggccatcgccagccacgatggcggcaacagccgctggaccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43948 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagactccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43949 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaccgcgtcccctgcgagacaccacaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 43950 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatcccacgctccttctcctacctcctcttcgacatcctcgtctcctcctccctctaccacctctccacagcctacttccctctcccttacctcgcctgacccctctactgggcctgccaagcctgcgtcctaacgggcctctgggtcatagcccacgagtgcggccaccacgccttcagcgactac

SEQ ID NO: 43951 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggagaactcaataaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43952 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43953 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 43954 - DNA, 279 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttcgacatcctcgtctcctcctccctctaccacctctccacagcctacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 43955 - DNA, 449 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccacccttcacaccacctgctccggggtcaagccgtgggcctggcacagcaccggcaacagcgcctgcaccgtctccagcgcctgcttgccaccaatattgctggcgatggccaccacctgctccggagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43956 - DNA, 309 bp, Artificial
  Mutation in BnaC.FAD2.b introduced by TALE nuclease pair BnFAD2_T03
caggatccatgggtgcaggtggaagaatgcaagtgtctcatccctccaagaagtctgaaaccgacaccatcaagaaagcaatcccacctcactgcttaaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43957 - DNA, 404 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctctgacttgagcgtcgatttttgtgatgctcgtcagggggggccatcgccagcaatggcggcggcaggccggcgctggaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43958 - DNA, 349 bp, Artificial
  Mutation in BnaC.FAD2.b introduced by TALE nuclease pair BnFAD2_T03
caggatccatgggtgcaggtggaagaatgcaagtctctcctccctccagttcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccaccgcctacttccatctcctcccccaccctctcccttacctcgcctggcccctctactgggcctgccaaggctgcgtcctaacgggcctctgggtcatcgcccacgaatgcggccaccacgccttcagcgactac

SEQ ID NO: 43959 - DNA, 346 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccgcccttcactaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaacgggcctctgggtcatcgcccacgaatgcggccaccacgccttcagcgactac

SEQ ID NO: 43960 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctccactgggcctgccaaggctgcgtcctaacgggcctctgggtcatcgcccacgaatgcggccaccacgccttcagcgactac

SEQ ID NO: 43961 - DNA, 395 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccccctggcttgaccccggagcaggtggtggccatcgccatccacgatggcggcaccagccgctggaccgagacctcaagaaagcaatcccacctcactgcttcaaacgctccatcccacgctccttctcctcttcgacatcatcatctcctcctcggctcctccctctcccacccctccacagcctacttccctctcccttacttcgcctgacccctctactgggcctgccaaggctgcgtcctaacgggcctctgggtcatagcccacgagtgcggccaccacgccttcagcgactac

SEQ ID NO: 43962 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgctgccaccacgccttcagcgactac

SEQ ID NO: 43963 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgtcaaggctgcgtcctaacgggcctctgggtcatagcccacgagtgcggccaccacgccttcagcgactac

SEQ ID NO: 43964 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43965 - DNA, 401 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcggcctttttacggttcctggccttttgctggccttttgctcacatgttctttcctgcgttatcccccgcgagacctcaagaaaacaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43966 - DNA, 336 bp, Artificial
  Mutation in BnaC.FAD2.b introduced by TALE nuclease pair BnFAD2_T03
caggatccatgggtgcaggtggaagaatgcaagtatctcccccctccagctcccccggaaccaacaccctcaaaagcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggcggcgtcctaaccggcgtctgggtcatagcccacgagggcggccaccacgccttcagccactac

SEQ ID NO: 43967 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgccccctctactgggcctgccaaggctgcgtcctaacgggcctctgggtcatagcccacgagtgcggccaccacgccttcagcgactac

SEQ ID NO: 43968 - DNA, 381 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggagagcgtaaaccgacaaacaaaagataaaacgaaacgcccagtaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43969 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccagctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 43970 - DNA, 362 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaatggcggtggcaagcaggcgctggagagacctcaagaaagcaatcccacctcactgcttcaaacgctccatcccacgctccttctcctcttcgacatcatcatctcctcctcggctcctccctctaccacctcaccacagcctacttccctctcccttacctcgcctgacccctctactgggccggccaaggctgcgtcctaacgggcctctgggtcatagcccacgagtgcggccaccacgccttcagcgactac

SEQ ID NO: 43971 - DNA, 332 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43972 - DNA, 349 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 43973 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctataccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43974 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 43975 - DNA, 331 bp, Artificial
  Mutation in BnaC.FAD2.b introduced by TALE nuclease pair BnFAD2_T03
caggatccatgggtgcaggtggaagaatgcaagtctctcctccctccagcccccccgaaaccaaaaccctcaaacgcgtcccctgcgagacctcaagaaagcaatcccacctcactgcttcaaacgctccatccctcgctccttctcctacctcatctgggacatcatcatagcctcctgcttctactacgtcgccaccacttacttccctctcctccctcaccctctcccttacctcgcctgacccctctactgggcctgccaaggctgcgtcctaacgggcctctgggtcatagcccacgagtgcggccaccacgccttcagcgactac

SEQ ID NO: 43976 - DNA, 339 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccacccttaaagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43977 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctgacccctctactgggcctgccaagggtgcgtcctaaccggcgtctgggtcatagcccacgagtgcggccaccacgccttcagcgactac

SEQ ID NO: 43978 - DNA, 348 bp, Artificial
  Mutation in BnaC.FAD2.b introduced by TALE nuclease pair BnFAD2_T03
caggatccatgggtgcaggtggaagaatgcaagtctctcctcactccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctccttccccaccctctcccttacctcgcctggcccctctactgggcctgccaaggctgcgtcctaacgggcctctgggtcatcgcccacgaatgcggccaccacgccttcagcgactac

SEQ ID NO: 43979 - DNA, 336 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43980 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgccccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43981 - DNA, 324 bp, Artificial
  Mutation in BnaC.FAD2.b introduced by TALE nuclease pair BnFAD2_T03
caggatccatgggtgcaggtggaagaatgcaagtctctcctccaccaacaccctcaaacgcgtcccctgcgagacaccaccattcactctcgggagacctcaagaaagcaatcccacctcactgcttcaaacgctccatcccacgctccttctcctcttcgacatcatcatctcctcctcggctcctccctctaccacctctccacagcctacttccctctcccttacctcgcctgaccactctactgggcctgccaaggctgcgtcctaacgggcctctgggccatagcccacgagtgcggccaccacgccttcagcgactac

SEQ ID NO: 43982 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacatcgcctggcccctctactgggcctgccaaggctgcgtcctaacgggcctctgggtcatcgcccacgaatgcggccaccacgccttcagcgactac

SEQ ID NO: 43983 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctcacctcaagaaagcaatcccacctcactgcttcaaacgctccatccctcgctccttctcctacctcctcttcgacatcctcgtctcctcctccctctaacacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43984 - DNA, 388 bp, Artificial
  Mutation in BnaC.FAD2.b introduced by TALE nuclease pair BnFAD2_T03
caggatccatgggtgcaggtggaagaatgcaagtctctcctcactccagctcccccgaaaccaaaaccctcaaacgcgtcccctgcgagacaccacccttcactctcggctgttgccggtgctgtgccaggcccacggcttgaccccccagcaggtggagacctcaagaaagcaatcccacctcactgcttcaaacgctccatccctcgctccttctcctcttcgacatcatcatctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 43985 - DNA, 345 bp, Artificial
  Mutation in BnaC.FAD2.b introduced by TALE nuclease pair BnFAD2_T03
caggatccatgggtgcaggtggaagaatgcaagtgtctcctccctccagctcacccgaaaccaaaaccctcaaacgcgtcccctgcgagacaccacccttcactcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43986 - DNA, 386 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcggcctttttacggttcctggccttttgctggccttttgctcacatgttctttcctgcgttatcccccgggagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 43987 - DNA, 331 bp, Artificial
  Mutation in BnaC.FAD2.b introduced by TALE nuclease pair BnFAD2_T03
caggatccatgggtgcaggtggaagaatgcaagtgtctcctccatccaagaagtctgaaaccgacaccatcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 43988 - DNA, 341 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccaccattcactagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 43989 - DNA, 381 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcatcaaactaagcagaaggccatccgtcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43990 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgacta

SEQ ID NO: 43991 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 43992 - DNA, 420 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgccggtgctgtgccaggcccacggcttgaccccccagcaggtggtggccatcgccagcaatggcggtggagacctcaagaaagcaatcccacctcactgcttcaaacgctccatccctccctccttctcccacctcctcttcgccatcctcgtctcctcctccctctcccacctctccacagcctacttccctctcctcccccaccccctcccttacctcgcctggcccctctactgggcctgccaaggctgcgtcctaacgggcctctgggtcatagcccacgaatgcggccaccacgccgtcagcgactac

SEQ ID NO: 43993 - DNA, 344 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcgaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 43994 - DNA, 348 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43995 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacagacctcaagaaagcaatcccacctcactgcttcaaacgctccatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43996 - DNA, 392 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgtggacaccaaggcctactccggcggctacaacctgcccatcggccaggccgacgaagaactcaagaaagcaatcccacctcactgcttcaaacgctccatccctcgctccttctcctacctcctcttcgacatcctcgtctcctcctccccctcccacctctccacagcctactcccctctcccttacctcgcctgacccctctactgggcctgccaaggctgcgtcctaacgggcctctgggtcatagcccacgagtgcggccaccacgccttcagcgactac

SEQ ID NO: 43997 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagaaaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 43998 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacacaacccttcactctcggcctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaagggtgcgtcctaacgggcctctgggtcatcgcccacgaatgcggccaccacgccttcagcgactac

SEQ ID NO: 43999 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgcaccatcccacgctccttctcctcttcgacatcatcatctcctcctcggctcctccctctaccacctccccacagcctacttccctctcccttacctcgccttacccctctactgggcctgccaaggctgcgtcctaacgggcctctgggtcatagcccacgagtgtggccaccacgccttcagcgactac

SEQ ID NO: 44000 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctgagacctcaagaaagcaatcccacctcactgcttcaaacgctccatccctcgctccttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44001 - DNA, 296 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatcaaacgctccatcccacgctccttctcctcttcgacatcatcatctcctcctcggctcctccctctaccacctctccacagcctacttccctctcccttacctcgcctggcccctctactgggcctgccaagggtgcgtcctaacgggcctctgggtcatagcccacgagtgcggccaccacgccttcagcgactac

SEQ ID NO: 44002 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 44003 - DNA, 384 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctaggcgacgaggtggtcgttggtcaacgcggccaacgccgtgagtcctcaagaaagcaatcccacctcactgcttcaaacgctccatccctcgctccttctcctacctcctcttctacatcatcatctcctcctcggctcctccctctcccacctctccaccgcctacttccctctccctttcctcgcctgacccctctactgggcctgccaaggctgcgtcctaacgggcctctgggtcatcgcccacgaatgcggccaccacgccttcagcgactac

SEQ ID NO: 44004 - DNA, 318 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcactgcttcaaacgctccatctcacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44005 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgaacctcaagaaagcaatcccacctaactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44006 - DNA, 266 bp, Artificial
  Mutation in BnaC.FAD2.b introduced by TALE nuclease pair BnFAD2_T03
caggatccatgggtgcaggtggaagaatgcaagtctcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccatgagtgcggccaccacgccttcagcgactac

SEQ ID NO: 44007 - DNA, 355 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctctccttctcctacctcctcttcgacatcctcgtctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44008 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44009 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgaacctcaagaaagcaatcccacctcactgcttcaaacgctccatcccacgctccttctcctcttcgacatcatcatctcctcctcgactcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44010 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 44011 - DNA, 400 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggagacggtccagcggctgttgccggtgctgtgccaggcccacggtccagcggctgttgccggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44012 - DNA, 336 bp, Artificial
  Mutation in BnaC.FAD2.b introduced by TALE nuclease pair BnFAD2_T03
caggatccatgggtgcaggtggaagaatgcaagtatctcctccatccagctcccccgaaaccaaaaccctcaaacgcgtcccctgcgagacaccacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 44013 - DNA, 401 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggggggaaagccggcgaacgtggcgagaaaggaagggaagaaagcgaaaggagcgggcgctaggagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44014 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgatacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44015 - DNA, 350 bp, Artificial
  Mutation in BnaC.FAD2.b introduced by TALE nuclease pair BnFAD2_T03
caggatccatgggtgcaggtggaagaatgcaagtttctcctccctcaagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacatcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44016 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcagacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44017 - DNA, 463 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccacccttcacaccacctgctccggggtcaagccgtgggcctggcacagcaccggcaacagcgcctgcaccgtctccagcgcctgcttgccaccaatattgctggcgatggccaccacctgctccggagacctcaagaaagcaatcccacctcactgctccaaacgctccatccctcgctccttctcctacccccccttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44018 - DNA, 331 bp, Artificial
  Mutation in BnaC.FAD2.b introduced by TALE nuclease pair BnFAD2_T03
caggatccatgggtgcaggtgcaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctccttctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44019 - DNA, 333 bp, Artificial
  Mutation in BnaC.FAD2.b introduced by TALE nuclease pair BnFAD2_T03
caggatccatgggtgcaggtagaagaatgcaagtttctcctccctccagctcccccggaaccaacaccctcaaacgcgtccccttcgagacaccaccattcactgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctggttcatagcccacgagtgcggccaccacgccttcagcgactac

SEQ ID NO: 44020 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 44021 - DNA, 292 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 44022 - DNA, 283 bp, Artificial
  Mutation in BnaC.FAD2.b introduced by TALE nuclease pair BnFAD2_T03
caggatccatgggtgcaggtggaagaatgcaagtctctcctccctccagtctctccacctcactgcttcaaacgctccatcccacgctccttctcctcttcgacatcatcatctcctcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 44023 - DNA, 246 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttaccacctctacacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 44024 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctagaaagcaatcccacctcactgcttcaaaccctccatccctcgctccttctcctatctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44025 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcacaagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44026 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaccgcgtcccctgcgagacaccaccactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44027 - DNA, 324 bp, Artificial
  Mutation in BnaC.FAD2.b introduced by TALE nuclease pair BnFAD2_T03
caggatccatgggtgcaggtggaagaatgcaagtctctcctccaccaacaccctcaaacgcgtcccctgcgagacaccaccattcactctcgggagacctcaagaaagcaatcccacctcactgcttcaagcgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44028 - DNA, 423 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctctccagcggctgttgccggtgctgtgccaggcccacggcttgaccccccagcaggtggtggccatcgccagcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44029 - DNA, 378 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcctgcttgccaccgccattgctggcgatggccaccacctttgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44030 - DNA, 336 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccaccattcacctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagcctgcgtcctaacgggcctctgggtcatagcccacgagttcggccaccacgccttcagcgactac

SEQ ID NO: 44031 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 44032 - DNA, 322 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattctcaagaaagcaatcccacctcactgcttcaaacgctccatcccacgctccttctcctcttcgacatcatcatctcctcctcggctcctccctctaccacctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44033 - DNA, 317 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44034 - DNA, 386 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctggcaacgctgcgatcatgtcctgatacttgacagcgacggtccctatcgcagacctcaagaaagcaatcccacctcactgcttcaaacgctccatcccacgctccttctcctcttcgacatcatcatctcctcctcggctcctccctctcccacctctccacagcctcctcccctctcccttacctcgcctgacccctctactgggcctgccaaggctgcgtcctaacgggcctctgggtcatagcccacgagtgcggccaccacgccttcagcgactac

SEQ ID NO: 44035 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaatgcgtcccctgcgagacaccacccttcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44036 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 44037 - DNA, 335 bp, Artificial
  Mutation in BnaC.FAD2.b introduced by TALE nuclease pair BnFAD2_T03
caggatccatgggtgcaggtggaagaatgcaagtgtctcctcactccagctcccccggaaccaacaccctcaaacgcgtcccctgcgagacaccaccattcactcggacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 44038 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 44039 - DNA, 315 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcatcccacctcactgcttcaaacgctccatcccacgctccttctcctcttcgacatcatcatctcctcctcgcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44040 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagactgcgtcctaacgggcctctgggtcatagcccacgagtgcggccaccacgccttcagcgactac

SEQ ID NO: 44041 - DNA, 400 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcttgaccccccagcaggtggtggccatcgccagccacgatggcggcaacagccgctggaccagacctcaagaaagcaatcccacctcactgcttcaaacgctccatccctcgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44042 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44043 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcatacttccctctcccttacctcgcctgacccctctactgggcctgccaaggctgcgtcctaacgggcctctgggtcatagcccacgagtgcggccaccacgccttcagcgactac

SEQ ID NO: 44044 - DNA, 372 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagcggctgttgccggtgctgtgccaggcccccgctcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44045 - DNA, 319 bp, Artificial
  Mutation in BnaC.FAD2.b introduced by TALE nuclease pair BnFAD2_T03
caggatccatgggtgcaggtggaagaatgcaagtttctactccctccagctcccccgaaaccaaaaccctcaaccgcgtcccctgcgagacaccacccttcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgtgtcatagcccacgagtgcggccaccacgccttcagcgactac

SEQ ID NO: 44046 - DNA, 348 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44047 - DNA, 352 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 44048 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 44049 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccagggctgcgtcctaacgggcctctgggtcatcgcccacgaatgcggccaccacgccttcagcgactac

SEQ ID NO: 44050 - DNA, 331 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44051 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44052 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaacgcgtcccctgcgagacaccacccttcactcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44053 - DNA, 399 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcccacggcttgaccccccagcaggtggtggccatcgccagcaatggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44054 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaccgcgtcccctgcgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44055 - DNA, 378 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgccccctgcgagacaccaccattcactctcgcctgcttgccaccgccattgctggcgatggccaccacctttgacctcaagaaagcaatcccacctcactgcttcaaacgctccatcccacgctccttctcctcttcgacatcatcatctcctcctcggctcctccctctaccacctctccccagcctacttccctctcccttacctcgcctggcccctctactgggcctgccaaggctgcgtcctaacgggcctctgggtcatagcccacgagtgcggccaccacgccttcagcgactac

SEQ ID NO: 44056 - DNA, 343 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcacatgagacctcaagaaagcaatcccacctcactgcttcaaacgctccatcccacgctccttctcctcttcgacatcatcatctcctcctccctctaccacctctccacagcctacttccctcgcctccctcaccctctctcctacttcgcctggcctctctactgggcctgccaagggtgcgtcctaaccggcgtctgggtcatagcccacgagtgcggccaccacgccttcagcgactac

SEQ ID NO: 44057 - DNA, 330 bp, Artificial
  Mutation in BnaC.FAD2.b introduced by TALE nuclease pair BnFAD2_T03
caggatccatgggtgcaggtggaagaatgcaagtctctcctccctcaagctaccccgaaaccaaaaccctcaaacgcgtccctgcgagacaccaccctttactctcggcttcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44058 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44059 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44060 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccacccttcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 44061 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctctgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44062 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44063 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44064 - DNA, 368 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaacaccatcaacatcgtggctggcgatggccaccacctgtgccaggcccacctcaagaaagcaatcccacctcactgcttcaaacgctccatcccacgctccttctcctcttcgacatcatcatctcctcctcggctcctccctctaccacctctccacgccctacttccctctcccttacctcgcctgacccctctactgggcctgccaaggctgcgtcctaacgggcctctgggtcatagcccacgagtgcggccaccacgccttcagcgactac

SEQ ID NO: 44065 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgacatcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44066 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagaaagcaatcccacctcactgcttcaaacgctccatcccacgctccttctcctcttcgacatcatcatctcctcctcggctcctccctctaccatctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44067 - DNA, 336 bp, Artificial
  Mutation in BnaC.FAD2.b introduced by TALE nuclease pair BnFAD2_T03
caggatccatgggtgcaggtggaagaatgcaagtctcccctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctccttccctctcccttacctcgcctggcccctctacgagacctgccaaggctgcgtcctgacgggcctctgggtcatagcccacaagtgcggccaccacgccttcagcgactac

SEQ ID NO: 44068 - DNA, 382 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactactgacagaaccgcaacgttgaaggagccactcagccgcgggtttctgagacctcaagaaagcaatcccacctcactgcttcaaacgctccatcccacgctccttctcctcttcgacatcatcatctcctcctcggctcctccctctaccacctctccacagcctactgccctctcccttacctcgcctgacccctctactgggcctgccaaggctgcgtcctaacgggcctctgggtcatagcccacgagtgcggccaccacgccttcagcgactac

SEQ ID NO: 44069 - DNA, 337 bp, Artificial
  Mutation in BnaC.FAD2.b introduced by TALE nuclease pair BnFAD2_T03
caggatccatgggtgcaggtggaagaatgcaagtttctcctccctccagctcccccggaaccaacaccctcaaacgcgtcccctgcgagacaccaccattcacctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcatgccaagactgcggcctaacgggcctctgggtcatagcccccgagtgcggccaccacgccttcagcgactac

SEQ ID NO: 44070 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaacgggcctctgggtcatcgcccacgaatgcggccaccacgccttcagcgactac

SEQ ID NO: 44071 - DNA, 401 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgaccccggagcaggtggtggccatcgccagccacgatggcggcaagcaggcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44072 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcatgaaagcaatcccacctcactgcttcaaacgctccatccctcgctccttctcctacctcctcttcgacatcctcgtctccttctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44073 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacatcctcaaacgcgtcccctgcgagacaccaccattcactcacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44074 - DNA, 337 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacggagacctcaagaaagcaatcccacctcactgcttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44075 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44076 - DNA, 411 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagttgccggtgctgtgccaggcccacggcttgaccccccagcaggtggtggccatcgccagcagacctcaagaaagcaatcccacctcactgcttcaaacgctccatcccacgctccttctcctcttcgacatcatcatctcctcctcggctcctccctccaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44077 - DNA, 350 bp, Artificial
  Mutation in BnaC.FAD2.b introduced by TALE nuclease pair BnFAD2_T03
caggatccatgggtgcaggtgcaagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 44078 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 44079 - DNA, 349 bp, Artificial
  Mutation in BnaC.FAD2.b introduced by TALE nuclease pair BnFAD2_T03
caggatccatgggtgcaggtggaagaatgcaagtgtctcctccctccagatcccctgaaaccaaaaccatcaagcgcgtcccctgcgagacaccacccttcactcagacctcaagaaagcaatcccacctcactgcttcaaacgctccatccctcgctccttctcctacctcctcttcgacatcctcgtcccctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44080 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcgaccaccacgccttcagcgactac

SEQ ID NO: 44081 - DNA, 347 bp, Artificial
  Mutation in BnaC.FAD2.b introduced by TALE nuclease pair BnFAD2_T03
cagtatccatgggtgcaggtggaagaatgcaagtctcccctccctccagctcccccgaaaccaaaaccctcaaacgcgtcccctgcgagacaccacccttcactgacctcaagaaaacaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaagtcggccaccacgccttcagcgactac

SEQ ID NO: 44082 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaacctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 44083 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcaccgcttcaaacgctccatccctcgctccttctcctacctcctcttcgacatcctcgtctcctcctccctctaccacctctccacagcctacttccctctcctccaccaccctctcccttacctcgcctggcccctctactgggcctgccaaggctgcgtcctaacgggcctctgggtcatcgcccacgaatgcggccaccacgccttcagcgactac

SEQ ID NO: 44084 - DNA, 333 bp, Artificial
  Mutation in BnaC.FAD2.b introduced by TALE nuclease pair BnFAD2_T03
ccggatccatgggtgcaggtggaagaatgcaagtctctcctccctccagctcccccggaaccaacaccctcaaacgcgtcccctgcgagacaccaccattcactctcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44085 - DNA, 350 bp, Artificial
  Mutation in BnaC.FAD2.b introduced by TALE nuclease pair BnFAD2_T03
caggatccatgggtgcaggtggaagaatgcaagtatctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44086 - DNA, 336 bp, Artificial
  Mutation in BnaC.FAD2.b introduced by TALE nuclease pair BnFAD2_T03
caggatccatgggtgcaggtggaagaatgcaagtctctcctccctccaactcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44087 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgtagagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 44088 - DNA, 384 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccgtccagcggctgttgccggtgttgtgcctggcggagacctcaagaaagcaatcccacctcactgcttcaaacgctccatcccacgctccttctcctcttcgacatcatcatctcctcctcggctcctccctctaccacctctccccagcctacttccctctcctcccccaccctcccccttacctcgcctggcccctctactgggcctgccaaggctgcgtcctaacgggcctctgggtcatagcccacgagtgcggccaccacgcctcagcgactac

SEQ ID NO: 44089 - DNA, 335 bp, Artificial
  Mutation in BnaC.FAD2.b introduced by TALE nuclease pair BnFAD2_T03
caggatccatgggtgcaggtggaagaatgcaagtctctcctctctcaagctcccccggaaccaacaccctcaaacgcgtcccctgcgagacaccaccattcactccgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccatggctgcttcctaacgggcctctgggtcatagcccacgagtgcggccaccacgccttcagcgactac

SEQ ID NO: 44090 - DNA, 385 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactctcgcttgaccccggagcaggtggtggccatcaccaaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44091 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgagtgcggccaccacgccttcagcgactac

SEQ ID NO: 44092 - DNA, 322 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaacctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44093 - DNA, 332 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 44094 - DNA, 406 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaacactccagcgcctgcttgccaccattattgctggcgatggccaccacctgctggggggtcaagttgagcggggcacccgtcagtgcattgcgccagagacctcaagaaagcaatcccacctcactgcttcaaacgctccatccctcgctccttctcctacctcctcttcgacatcctcgtctcctcctccctctaccacctctccacagcctacttccctctccttccccaccctctcccttacctcgcctggcccctctactgggcctgccaaggctgcgtcctaacgggcctctgggtcatagcccacgagtgcggccaccacgccttcagcgactac

SEQ ID NO: 44095 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaaggctgcgtcctaacgggcctctgggtcatagcccacgagtgcggccaccacgccttcagcgactac

SEQ ID NO: 44096 - DNA, 333 bp, Artificial
  Mutation in BnaC.FAD2.b introduced by TALE nuclease pair BnFAD2_T03
caggatccatgggtgcaggtggaagaatgcaagtctctcctccctccagctccaccgaaaccaaaaccctcaaacgcgtcccctgcgagacaccacccttcactcacctcaagaaagcaatcccacctcactgcttcaaacgctccatcccacgctccttctcctcttcgacatcatcatctcctcctcggctcctccctctaccacctctccacaacctacttccctctcccttacctcgcctgacccctctactgggcctgccaaggctgcgtcctaacgggcctctgggtcatagcccacgagtgcggccaccacgccttcagcgactac

SEQ ID NO: 44097 - DNA, 366 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctctgagcctttcgttttatctgttgtttgtcggtgaacgctctcctgagacctcaagaaagcaatcccacctcactgcttcaaacgctccatccctcgctccttctcctacctcctcggctcctccctctcccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 44098 - DNA, 392 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactctcggtccagcggctgttgccggtgctgggaagccgaagtttccaaaaggtcgttgatcaaacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44099 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 44100 - DNA, 419 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctctccagcgcctgcttgccggtgctgtgccaggcccacggcttgaccccccagcaggtggtggccatcgccagcaataatggggagacctcaagaaagcaatcccacctcactgcttcaaacgctccatcccacgctccttctcctcttcgacatcatcatctcctcctcggctcctccctctgccacctctccacagcctactcccctctcccttacctcgcctgacccctctactgggcctgccaaggctgcgtcctaacgggcctctgggtcatagcccacgagtgcggccaccacgccttcagcgactac

SEQ ID NO: 44101 - DNA, 370 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtggataaccgtattaccgcctttgagtgagctgacctcaagaaagcaatcccacctcactgcttcaaacgctccatcccatgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44102 - DNA, 316 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgggagaactcatgaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44103 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccatccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44104 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacacctacctcaagaaagcaatcccacctcactgcttcaaacgctccatcccaccctccttctcctctccgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44105 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagacctcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatcgcccacgaattcggccaccacgccttcagcgactac

SEQ ID NO: 44106 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcgtccaccacgccttcagcgactac

SEQ ID NO: 44107 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctcacctcccccaccctctcccttacctcgcctggcccctctactgggcctgccagggctgcgtcctaaccggcgtctgggtcatagcccacgagtgcggccaccacgccttcagcgactac

SEQ ID NO: 44108 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctacgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 44109 - DNA, 336 bp, Artificial
  Mutation in BnaC.FAD2.b introduced by TALE nuclease pair BnFAD2_T03
caggatccatgggtgcaggtggatgaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44110 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctagacctcaagaaagcaatcccacctcactgcttcaaacgctccatcccacgctccttctcctcttcgacatcatcatctcctcatcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 44111 - DNA, 365 bp, Artificial
  Mutation in BnaC.FAD2.b introduced by TALE nuclease pair BnFAD2_T03
caggatccatgggtgcaggtggaagaatgcaagtctctcctccctccagctcccccggaacaaacaccctcaaacgcgtcccctgcgagacaccaccattcactctcggctcttgatccggcaaaaaaaccaccgctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44112 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgcctacagcgctac

SEQ ID NO: 44113 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgtgcctctgggtcatagcccacgagtgcggccaccacgccttcagcgactac

SEQ ID NO: 44114 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 44115 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44116 - DNA, 335 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44117 - DNA, 345 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44118 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccatcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagctactac

SEQ ID NO: 44119 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgttccctgcgagacaccaccattcactctgagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44120 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgggtcaagccgtgggcctggcacagcaccggcaagcaggcgctggagagacctcaagaaagcaatcccacctcactgcttcaaacgctccatccctcgctccttctcctacctcctcttcgacatcctcgtctcctcctccctctcccccctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44121 - DNA, 382 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgagcgccaccacgaaccgacgctgcttgccgagtcctcaagcaaccactcccacctcactgcttcaaacgctccatccccagctccttctcctacctcccctcccacctccccgtctcctcctccctctaccacctctccacagcctacttccctccccccccccaccctctcccttacctcgcctggcccctctactgggcctgccaaggctgcgtcctaacgggcctctgggtcatcgcccacgaatgcggccaccacgccttcagcgactac

SEQ ID NO: 44122 - DNA, 416 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagcgcctgctgccggtgctgtgccaggcccacggcttgaccccccagcaggtggtggccatcgccagcaataatggtggcagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44123 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgccagacaccaccattcactctcagacctcaagaaagcaatcccacctcactgcttcaaacgctccatcccacgctccttctcctcttcgacatcatcatctcctcctcggctcctccctctaccacctctccacagcctactaccctctcccttacctcgcctgacccctctactgggcctgccaaggctgcgtcctaacgggcctctgggtcatagcccacgaatgcggccaccacgccttcagcgactac

SEQ ID NO: 44124 - DNA, 347 bp, Artificial
  Mutation in BnaC.FAD2.b introduced by TALE nuclease pair BnFAD2_T03
caggatccatggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44125 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgccagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44126 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgctccccctgcgagacaccaccattcactcaaacctcaggaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44127 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcacgaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44128 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcatcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagtgactac

SEQ ID NO: 44129 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgagcccccgatttagagcttgacggggagaactcaagaaagcaatcccaccgcactgtttaaaacgctcgatccctcgctctttctcctacctcctcttcgacatcctcgtctcctcctccctctaccacctctccacagcctacttccctctcctcccccaccctctcccttacctcgcctggtccctctactgggcctgccagggctgcgtcctaaccggcgtctgggtcatagcccacgaatgcggccaccacgccttcagcgactac

SEQ ID NO: 44130 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctagacctcaataaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44131 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgtggccaccacgccttcagcgactac

SEQ ID NO: 44132 - DNA, 347 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcacagacctcaagaaagcaatcccacctcactgctttaaacgctccatccctcgctccttctcctacctcctcttcgacatcctcgtctcctcctccctctaccacctctccacagcctacttccctctcctccccccccctctcccttacctcgcctggcctctctactgggcctgccagggctgcgtcctaaccggcgtctgggtcatagcccacgagtgcggccaccacgccttcagcgactac

SEQ ID NO: 44133 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaggacctcaagaaagcaatcccacctcactgcttcaaacgccccatcccacgctccttctcctcttcgccatcatcatctcctcctcggctcctccctctaccacctctccacagcctacttccctctcctcccccaccctctcccttacctcgcctggcccctctacggggcctgccaaggctgcgtcctaacgggcctctgggtcatagcccacgagtgcggccaccacgccttcagcgactac

SEQ ID NO: 44134 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagaaagcaatcccacctcactgcttcaaacgctccatcccacgctccttctcctcttcgacatcatcatctcctcctcggctcctccctctaccacctctccacagcctacttccctctcccttccctcgcctggcccctctactgggccggccaaggctgcggccgaacgggcctctgggtcatagcccacgagtgcggcctccgcgccttcagcgactac

SEQ ID NO: 44135 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaggacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 44136 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44137 - DNA, 386 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggggtcaagccgtgggcctggcacagcaccggcaacagccgctggaccgagacctcaagaaagcaatcccacctcactgcttcaaacgctccatccctcgctccttctcctcttcgacatcatcatctcctcctcggctcctccctctcccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 44138 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgagtgcggccaccacgccttcagcgactac

SEQ ID NO: 44139 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatcccacgctccttctcctcttcgacatcatcttctcctcctcggctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 44140 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacgagacctcaagaaagcaatcccacctcactgcttcaaacgctccatcccacgctccttctcctcttcgacatcatcatctcctcctccctctaccacctctccacaacctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44141 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcggggtcatagcccacgagtgcggccaccacgccttcagcgactac

SEQ ID NO: 44142 - DNA, 311 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccatcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 44143 - DNA, 317 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44144 - DNA, 335 bp, Artificial
  Mutation in BnaC.FAD2.b introduced by TALE nuclease pair BnFAD2_T03
caggatccatgggtgcaggtggaagaatgcaagtctatactcactccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44145 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44146 - DNA, 453 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgtccagcggctgttgccggtgctgtgccaggcccacggcttgaccccggagcaggtggtggccatcgccagcaatattggtggcaagcaggcgctggcacaaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 44147 - DNA, 406 bp, Artificial
  Mutation in BnaC.FAD2.b introduced by TALE nuclease pair BnFAD2_T03
caggatccatgggtgcaggtggaagaatgcaagtctctcctcactccagctcccccggaaccaacaccctcaaacgcgtcccctgcgagacaccaccattcactctcgacgctcaagtcagaggtggcgaaacccgacagcactataaagataccaggcgttagacctcaagaaatcaatcccacctcactgcttcaaacgctccatccctcgctccttctcctacctcctcttcgacatcctcgtctcctcctccctctaccacctctccacagcctgcttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44148 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtccccgcgagacaccaccattcactctagacctcaagaaagcaatcccacctcactgcttcaaacgctccatcccacgctccttctcctcttcgacatcatcatctcctcctctgctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44149 - DNA, 356 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 44150 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccatgccttcagcgactac

SEQ ID NO: 44151 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcaggactac

SEQ ID NO: 44152 - DNA, 272 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcctcggctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 44153 - DNA, 338 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaaaacaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgtcaagggtgcgtcctaaccggcgtctgggtcatagcccacgagtgcggccaccacgccttcagcgactac

SEQ ID NO: 44154 - DNA, 357 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggcctttttacggttcctctccctcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44155 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44156 - DNA, 330 bp, Artificial
  Mutation in BnaC.FAD2.b introduced by TALE nuclease pair BnFAD2_T03
catgatccatgggtgcaggtggaagaatgcaagtctctcctccctccagctcccccggaaccaacaccctcaaacgcgtcccctgcgagacaccaccattcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44157 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44158 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtcggggtcatcgcccacgaatgcggccaccacgccttcagcgactac

SEQ ID NO: 44159 - DNA, 350 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcctctgggtcatagcccacgagtgcggccaccacgccttcagcgactcc

SEQ ID NO: 44160 - DNA, 346 bp, Artificial
  Mutation in BnaC.FAD2.b introduced by TALE nuclease pair BnFAD2_T03
caggatccatgggtgcaggtggaagaatgcaagtctctcctccctccaactcccccgaaaccaaaaccctcaaacgcgtcccctgcgagacaccacccttaaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44161 - DNA, 282 bp, Artificial
  Mutation in BnaC.FAD2.b introduced by TALE nuclease pair BnFAD2_T03
caggatccatgggtgcaggtggaagaatgcaagtctctcgacctcaagaaagcaatcccacctcactgcttcaaacgctccatccctcgctccttctcctacctcctcttcgacatcctcgtctcctcctccctctaccacctctccacagcctacttccctctccccccccaccctctcccttacctcgcctggcccctctactgggcctgccaaggctgcgtcctaacgggcctctgggtcatcgcccacgaatgcggccaccacgccttcagcgactac

SEQ ID NO: 44162 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactcggacctcaagaaagcaatcccacctcactgcttcaaacgctccatcccacgctccttctcctcttcgacatcatcatctcctcctcggctcctccctctaccacctctccacagcctacttccctctcccttacctcgcctgaccactctactgggcctgccaaggctgcgtcctaacgggcctctgggtcatagcccacgagtgcggccaccacgccttcagcgactac

SEQ ID NO: 44163 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacactccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcgaccaccacgccttcagcgactac

SEQ ID NO: 44164 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactactgacagaaccgcaacgttgaaggagccactcagccgcgggtttctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44165 - DNA, 309 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgccagacctcaagaaagcaatcccacctcactgcttcaaacactccatcccacgctccttctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44166 - DNA, 420 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtgttgtgccaggcccacggcttgaccccggagcaggtggtggccatcgccagccacgatggcggcaacagccgctggacccagacctcaagaaagcaatcccacctcactgcttcaaacgctccatcccacgctccttctcctctgcgacatcatcatctcctcctcggctcctccctctgccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44167 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44168 - DNA, 367 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaccctcaaacgcgtcccctgcgagacaccacccttcactctcgagcgccatctcgaaccgacgttgctggccgagacctcaagacagcaatcccacctcactgcttcaaacgctccatcccaccctccttctcctcttcgacatcatcatctcctcctcggctcctccctctcccacctctccaccgcctccttccctctcccttacctcgcctggcccctctactgggcctgccaaggctgcgtcctaacgggcctctgggtcatagcccacgagtgcggccaccacgccttcagcgactac

SEQ ID NO: 44169 - DNA, 338 bp, Artificial
  Mutation in BnaC.FAD2.b introduced by TALE nuclease pair BnFAD2_T03
caggatccatgggtgcaggtggaagaatgcaagtttctcctccctccagctcccccgaaaccaaaaccatcaaccgcgtcccctgcgagacaccaccactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgccttgcccctctactgggcctgccaaggctgcgtcctaacgggcctctgggtcatcgcccacgaatgcggccaccacgccttcagcgactac

SEQ ID NO: 44170 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 44171 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggcctcaagaaagcaatcccacctcactgcttcaaacgctccatcccacgctccttctcctcttcgacatcatcatctcctcctcggctcctccctctaccacatctccacagcctacttccctctcccttacctcgcctgacccctctactgggcctgccaaggctgcgtcctaacgggcctctgggtcatagcccacgagtgcggccaccacgccttcagcgactac

SEQ ID NO: 44172 - DNA, 313 bp, Artificial
  Mutation in BnaC.FAD2.b introduced by TALE nuclease pair BnFAD2_T03
caggatccatgggtgcaggtgaaagaatgcaagtctcaactccctccagctcccccgaaaccaaaaccctcaaacgcgtcccctgcgagacaccaccattcactcagacctcaagaaagcaatcccacctcactgcttcaaacgctccatcccacgctccttctcctcttcgacatcatcatctcctcctcggctcctccctcaccctctcccttaccccgcctggcccctctactgggcctgccaaggctgcgtcctaacgggcctctgggtcatcgcccacgaatgcggccaccacgccttcagcgactac

SEQ ID NO: 44173 - DNA, 348 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 44174 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 44175 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44176 - DNA, 305 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccctcaaacgcgtcccctgcgagacaccaccattcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44177 - DNA, 335 bp, Artificial
  Mutation in BnaC.FAD2.b introduced by TALE nuclease pair BnFAD2_T03
caggatccatgggtgcaggtggaagaatgcaagtctctcctccctccagctccctcggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44178 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatccctcgctccttctcctacctcctcttcgacatcctcgtctcctcctccctctaccacctctccacagcctacttccatctcctccctcaccctctctcctacttcgcctggcctctctactgggcctgccatggctgcgtcctaaccggcgtctgggtcatcgcccacgaatgcggccaccacgccttcagcgactac

SEQ ID NO: 44179 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagacctcaagaaagcaatcccacctcactgcttcaaacgctccatcccacgctccttctcctcttctacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44180 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacaaacctcaacaaaacgatcccacctcactgcttcaaatgctccatcccacgctccttctcctcttcgacatcatcatctcctcctcgtctcctccctctaccacctctccacagcctccttccctctcccttacctcgccggacccctctacggggcctgccagggctgcgtcctaacgggcctctggttcatagccacgaatgcggccaccacgccttcagcgactac

SEQ ID NO: 44181 - DNA, 300 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaagcaagcaatcccacctcactgcttcaaacgctccatccctcgctccttctcctacctcctcttccacatcctcgtctcctcctccctctaccacctctccacagcctacttccctctccccccccaccctctcccttacctcgcctggcccctctacggggcctgccaaggctgcgtcctaacgggcctctgggtcatagcccacgagtgcggccaccacgccttcagcgactac

SEQ ID NO: 44182 - DNA, 296 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccatcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44183 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 44184 - DNA, 279 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcacacgaatgcggccaccacgccttcagcgactac

SEQ ID NO: 44185 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccctacctcgcctggcctctctactgggcctgccaaggctgcgtcctaacgggcctctgggtcatcgcccacgaatgcggccaccacgccttcagcgactac

SEQ ID NO: 44186 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaattcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44187 - DNA, 381 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactactgacagaaccgcaacgttgaaggagccactcagccgcgggtttctgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44188 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactacttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44189 - DNA, 259 bp, Artificial
  Mutation in BnaC.FAD2.b introduced by TALE nuclease pair BnFAD2_T03
caggatccatgggtgcaggtggaagaatgcaagtctctcatccctccaggtagacctcaagaaagcaatcccaccgcactgtttcaaacgctcgatcccacgctccttctcctcttcgacatcatcatctcctcctcggctcctccctcaccctctctcctacttcgcctggcccctctactgggcctgccaaggctgcgtcctaacgggcctctgggtcatcgcccacgaatgcggccaccacgccttcagcgactac

SEQ ID NO: 44190 - DNA, 334 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccaccattcactagacctcaagaaagcaatcccacctcattgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44191 - DNA, 317 bp, Artificial
  Mutation in BnaC.FAD2.b introduced by TALE nuclease pair BnFAD2_T03
caggatccatgggtgcaggtggaagaatgcaagtctctcctccctccagcttccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44192 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 44193 - DNA, 348 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccatcaaacgcgtcccctgcgagacaccacccttcactctacctcaagaaagcaatcccacctcactgctccaaacgctccatccctcgctccttctcctacctcctcttcgacatcctcgtctcctcctccctctaccacctctccccagcccacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44194 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttagaactcaagaaagcaatcccaccgcactgtttcaaacgctcgatccctcgctctttctcctacctcctcttcgtcatcctcgtctcctcctccctctaccacctctccacagcctaataaactctactaccccaccctctcccttacctcgcctggcccctctactgggcctgccaaggctgcgtcctaacgggcctctgggtcatcgcgcaagaatgcggccaccacgccatcagcgagtac

SEQ ID NO: 44195 - DNA, 336 bp, Artificial
  Mutation in BnaC.FAD2.b introduced by TALE nuclease pair BnFAD2_T03
caggatccatgggtgcaggtgggagaatgcaagtgtctcctccctccagctcccccggaaccaacaccctcaaacgcgtcccctgcgagacaccaccattcactctcaacctcaagaaagcaatcccacctcactgcttcaaacgctccatcccacgccccttctcctcttcgacatcatcatctcctcctcggctcctccctctaccacctctccacagcctacttccctctcccttacctcgcctggcctctctactgggcctgccaaggctgcgtcctaacgggcctctgggtcatcgcccacgaatgcggccaccacgccttcagcgactac

SEQ ID NO: 44196 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaaggcggccaccacgccttcagcgactac

SEQ ID NO: 44197 - DNA, 449 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagcttccagggggaaacgcctggtatctttatagtcctgtcgggtttcgccacctctgacttgagcgtcgatttttgtgatgctcgtcaggggggcggagacctcaagaaagcaatcccacctcactgcttcaaacgctccatccctcactccttcccccaccccccccccgacctccccctccccccccccccctaccccccctcccccgcctacttccccccccccccccaccctctcccttccctcgcctggcccctctactgggcctgccaaggctgcgtcctaacgggcctctgggtcatagcccacgagtgcggccaccacgccttcagcgactac

SEQ ID NO: 44198 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccatcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44199 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggcggcgtcctaacgggcctctgggtcatagcccacgagtgcggccaccacgccttcagcaactac

SEQ ID NO: 44200 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgcctccagcgactac

SEQ ID NO: 44201 - DNA, 407 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgggcctggcacagcaccggcaacagccgctggaccgtctccagcgcctgcttgcgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 44202 - DNA, 337 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44203 - DNA, 335 bp, Artificial
  Mutation in BnaC.FAD2.b introduced by TALE nuclease pair BnFAD2_T03
caggatccatgggtgcaggtggaagaatgcaagcctctcctccctccagctcccccggaaccaacaccctcaaacgcgtcccctgcgagccaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcccctgacccctctactgggccttccgaggctgcgtcctaacgggcctcggggtcatagcccacgagtgcggccaccacgccttcagcgactgc

SEQ ID NO: 44204 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttacctcactgcttcaaacgctccatccctcgctccttctcctacctcctcttcgacatcctcgtctcctcctccctctaccacctctccacagcctacttccctctcctcccccaccctctcccttccctcgcctgacccctctactgggcctgccaaggctgcgtcctaacgggcctctgggtcatagcccacgagtgcggccaccacgccttcagcgactac

SEQ ID NO: 44205 - DNA, 350 bp, Artificial
  Mutation in BnaC.FAD2.b introduced by TALE nuclease pair BnFAD2_T03
caggatccatgggtgcaggtggaagaatacaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44206 - DNA, 317 bp, Artificial
  Mutation in BnaC.FAD2.b introduced by TALE nuclease pair BnFAD2_T03
caggatccatgggtgcaggtggaagaatgcaagtctctcctccccccagctcccccgaaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 44207 - DNA, 448 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagcgcctgcttgccgccatcgtggctggcgatggccaccacctgctccggggtcaagccgtgggcctggcacagcaccggcaacagccgctggacggagacctcaagaaagcaatcccacctcactgcttcaaacgctccatccctcgctcctccccctacctcctctccgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44208 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctacccccccccctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 44209 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcgacctcaagaaagcaatcccacctcactgcttcaaacgctccatcccacgctccttctcctcttcgacatcatcatctcctcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44210 - DNA, 335 bp, Artificial
  Mutation in BnaC.FAD2.b introduced by TALE nuclease pair BnFAD2_T03
caggatccatgggtgcaggtggaagaatgcaagtctcccctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44211 - DNA, 295 bp, Artificial
  Mutation in BnaC.FAD2.b introduced by TALE nuclease pair BnFAD2_T03
caggatccatgggtgcaggtggaagaatgcaagtctctcatccctccaggtagacctcaagaaagcaatcccacctcactgcttcaaacgctccatccctcgctccttctcctacctcctcttcgacatcctcgtctcctcctccctctaccacctctccacagcctacttccctctcctccctcagcctctcccttacctcgcctggcccctctactgggcctgccaaggctgcgtcctaacgggcctctgggtcatcgcccacgaattcggccaccacgccttcagcgactac

SEQ ID NO: 44212 - DNA, 403 bp, Artificial
  Mutation in BnaC.FAD2.b introduced by TALE nuclease pair BnFAD2_T03
caggatccatgggtgcaggtggaagaatgcaagtgtctcctccctcaaaaaagtctgaaaccgacaacatcaagcgcgtaccctgcgagacaccgcccttcactgttggcgatggccaccacctgctggggggtcaagccgtgggcctggcacagcaccagaactcaagaaagcaatcccacctcactgcttcaaacgctccatccctcgctccttctcctacctcctcttcgacatcctcgtctcctcctccctctaccccctctccacagcctacttccctctcctcccccaccctctcccttacctcccctggcccctctactgggcctgccaaggctgcggcctaactggcctctgggtcatagcccacgagtgcggcctccacgccttcagcgactac

SEQ ID NO: 44213 - DNA, 332 bp, Artificial
  Mutation in BnaC.FAD2.b introduced by TALE nuclease pair BnFAD2_T03
caggatccaggtgcaggtggaagaatgcaagtgtctcctccctccaagaagtctgaaaccgacaccatcaagcgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctaccaaggctgcgtcctaacgggcctctgggtcatagcccacgagtgcggccaccacgccttcagcgactac

SEQ ID NO: 44214 - DNA, 305 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44215 - DNA, 355 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtccccctgcgagacaccacaccgcccgccataaactgccaggcatcaaacagcggagacctcaagaaagcaatcccacctcactgcttcaaacgctccatccctcgctccttctcctcttcgacatcatcatctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44216 - DNA, 334 bp, Artificial
  Mutation in BnaC.FAD2.b introduced by TALE nuclease pair BnFAD2_T03
caggatccatgggtgcaggtggaagaatgcaagtctctcctccctcaagctcccccggaaccaacaccctaaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44217 - DNA, 350 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccaccattcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44218 - DNA, 439 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggggaaacgcctggtatctttatagtcctgtcgggtttcgccacctctgacttgagcgtcgatttttgtgatgctcgtcaggggggcagacctcaagaaagcaatcccacctcactgcttcaaacgctccatccctcgctccttcccctacccccccttcgacatcctcgtctcctcctccctccaccccctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44219 - DNA, 276 bp, Artificial
  Mutation in BnaC.FAD2.b introduced by TALE nuclease pair BnFAD2_T03
caggatccatgggtgcaggtggaagaatgcaagtctctcctctcggagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 44220 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctttcagcgactac

SEQ ID NO: 44221 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagaacctcaagaaagcaatcccacctcactgcttcaaacgctccatccctcgctccttctcctacctcctcttcgacatcctcgtctcctcctccctctaccacctctccacagcctacttccctctcctcccccaccctctccctttcctcgcctggcccctctactgggcctgccaaggctgcgtcctaacgggcctctgggtcatcgcccacgaatgcggccaccacgccttcagcgactac

SEQ ID NO: 44222 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctctgggtcatagcccacgagtgcggccaccacgccttcagcgactac

SEQ ID NO: 44223 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 44224 - DNA, 322 bp, Artificial
  Mutation in BnaC.FAD2.b introduced by TALE nuclease pair BnFAD2_T03
caggatccatgggtgcaggtggaagaatgcaattttatcctccctccagctcccccggaaccaaaaccctcaaacgcgtccccttcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44225 - DNA, 333 bp, Artificial
  Mutation in BnaC.FAD2.b introduced by TALE nuclease pair BnFAD2_T03
caggatccatgggtgcaggtggaagaatgcaagtctctcctcactccagctcccccggaaccaacaccctcaaacgcgtcccctgcgagacaccacccttcactaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctggttcatagcccacgagtgcggccaccacgccttcagcgactac

SEQ ID NO: 44226 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgccttcatcatctcctcctcgcctcctccctctaccacctctccccagcctacttccctctcccttacctcgcctgacccctctactgggcctgccaaggctgcgtcctaacgggcctctgggtcatagcccacgagtgcggccaccacgccttcagcgactac

SEQ ID NO: 44227 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcaagaaagcaatcccacctcactgcttcaaacgctcgatccctcgctccttctcctacctcctcttagacatcctcgtctcctcctccctctaccacctctccacagcctacttccctctcccttacctcgcctgccccctctcctcggcctgccaaggctgcgtcctaacgggcctctgggtcatagcccacgagtgcggccaccacgccttcagcgactac

SEQ ID NO: 44228 - DNA, 407 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttcttcctggctagcggtacgcgtattaattgcgttgcgctcactgcccgctttccagagacctcaagaaagcaatcccacctcactgcttcaaacgctccatccctcgctccttctcctacctcctcttcgacatcctcgtctcctcctccctctaccccctctccacagcctacttccccctcctcccccaccctctcccttccctcgcctggcccctctactgggcctgccaaggctgcgtcctaacgggcctctgggtcatcgcccacgaatgcggccaccacgccttcagcgactac

SEQ ID NO: 44229 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctactcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44230 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcaaacctcaagaaagcaatcccacctcactgcttcaaaccctccatcccaccctccttctcctcttcgacatcatcatctcctcctccttctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44231 - DNA, 365 bp, Artificial
  Mutation in BnaC.FAD2.b introduced by TALE nuclease pair BnFAD2_T03
cagtatccatgggtgcaggtggaagaatgcaagtctctcctccctccagctcccccgaaaccaaaaccctcaaacgcgtcccctgcgagacaccacccttcactcttgaacgctctcctgagtaggacaaatccgctccctcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 44232 - DNA, 362 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaatggcggtggcaagcaggcgctcgagagacctcaagaaagcaatcccacctcactgctgcaaacgctccatcccacgctccttctcctcttcgacatcatcatctcctcctcgtcccctccctctaccacctctccacagcctccttccctctcccttacctcgcctggcccctctactgggcctgccaaggctgcgtcctaacgggcctctgggtcatagcccacgagtgcggccaccacgccttcagcgactac

SEQ ID NO: 44233 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcctcaagaaagcaatcccacctcactgcttcaaacgctccatccctcgctccttctcctacctcctcttcgacatcctcgtctcctcctccctctaccacctctccacagcctacttccctctcctcccccacactctcccttacctcgcctggcccctctactgggcctgccaaggctgcgtcctaacgggcctctgggtcatcgcccacgaatgcggccaccacgccttcagcgactac

SEQ ID NO: 44234 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44235 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 44236 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 44237 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44238 - DNA, 336 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44239 - DNA, 350 bp, Artificial
  Mutation in BnaC.FAD2.b introduced by TALE nuclease pair BnFAD2_T03
caggatccatgggtgcaggtgcaagaatgcaagtctcccctcactccagctcccccgaaaccaaaaccctcaaacgcgtcccctgcgagacaccacccttcaccctcgacctcaagaaagcaatcccccctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44240 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatcccacgctccttctcctcttcgacatcatcatctcctcctcggttcctccctctaccacctctccacagcctacttccctctcccttacctcgcctgacccctctactgggcctgccaaggctgcgtcctaacgggcctctgggtcatagcccacgagggcggccaccacgccttcagcgactac

SEQ ID NO: 44241 - DNA, 338 bp, Artificial
  Mutation in BnaC.FAD2.b introduced by TALE nuclease pair BnFAD2_T03
caggatccatgggtgcaggtggaagaatgcaagtctcccctccctccagctcccccggaaccaacaccctcaaacgcgtcccctgcgagacaccaccattcacttcgtagacctcaagaaagcaatcccacctcactgcttcaaacgctccatcccacgctccttctcctcttcgacatcatcatctcctcctcggctcctccctctaccacctctccacagcctccttccctctcccttccctcgcctgacccctctactcggccagctaagcctgcgtcctagcgggcctctgggtcatagcccacgagtgcggccaccacgccttcagcgactac

SEQ ID NO: 44242 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 44243 - DNA, 331 bp, Artificial
  Mutation in BnaC.FAD2.b introduced by TALE nuclease pair BnFAD2_T03
caggatccatgggtgcaggtggaagaatgcaagtctctcctccctccagctccaccggaaccaacaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44244 - DNA, 386 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggggtcaagccgtgggcctggcacagcaccggcaccagccgctggaccgagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44245 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44246 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgagacctcaagaaagcaatcccacctcactgcttcaaacgctcgatccctcgctctttctcctacctcatctgggacatcatcattgcctcctgcttctactacgtcgccaccacttacttccctctcctcccccaccctctcccttacctcgcctggcccctctactgggcctgccaaggctgcgtcctaacgggcctctgggtcatcgcccacgaatgcagccaccacgccttcagcgactac

SEQ ID NO: 44247 - DNA, 329 bp, Artificial
  Mutation in BnaC.FAD2.b introduced by TALE nuclease pair BnFAD2_T03
caggatccattggtgcaggtggaagaatgcaagtctctcctccctccagctcccccgaaaccaaaaccctcaaacgcgtcccctgcgagacatcatcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgtgcctctgggtcatagcccacgagtgcggccaccacgccttcagcgactac

SEQ ID NO: 44248 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44249 - DNA, 410 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggaagaatttgtccactacgtgaaaggcctggcacagcaccggcaacagccgctggacgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44250 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccccctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44251 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44252 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44253 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44254 - DNA, 468 bp, Artificial
  Mutation in BnaC.FAD2.b introduced by TALE nuclease pair BnFAD2_T03
caggatccatgggtgcaggtggaagaatgcaagtttctcctccctccagctcccccgaaaccaaaaccctcaaacgcgtcccctgcgagacaccacccttcactctcggtggccatcgccagcaataatggtggcaagcaggcgctggagacggtccagcggctgttgccggtgctgtgccaggcccacggcttgaccccccagcaggtgggggccaccgccagagacctcaagaaagcaatcccacctccctgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44255 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaagggcctctgggtcatagcccacgagtgcggccaccacgccttcagcgactac

SEQ ID NO: 44256 - DNA, 317 bp, Artificial
  Mutation in BnaC.FAD2.b introduced by TALE nuclease pair BnFAD2_T03
caggatccatgggtgcaggtggaagaatgcaagtctctcctccctccagcttccccggaaccaacaccctcaaacgcgtcccctgcgagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44257 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44258 - DNA, 343 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44259 - DNA, 342 bp, Artificial
  Mutation in BnaC.FAD2.b introduced by TALE nuclease pair BnFAD2_T03
caggatccatgggtgcaggtggatgaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44260 - DNA, 335 bp, Artificial
  Mutation in BnaC.FAD2.b introduced by TALE nuclease pair BnFAD2_T03
caggatccatgggtgcaggtggaagaatgcaagtctctcctccctccaagaagcctgaaaccgacaccctcaaacgcgtcccctgcgagacaccaccattcactcacgcctcacgaaagcaatcccacctcactgcctcaaacgctccatcccacgctccttctcctcttcgacatcaccatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44261 - DNA, 347 bp, Artificial
  Mutation in BnaC.FAD2.b introduced by TALE nuclease pair BnFAD2_T03
caggatccatgggtgcaggtggaagaatgcaagtctctactccctcaagctcccccggaaccaacaccctcaaacgcgtcccctgcgagacaccaccattcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44262 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcccctgacccctctactgggcctgccaaggctgcgtcctaacgggcctctgggtcatagcccacgagtgcggccaccacgccttcagcgactac

SEQ ID NO: 44263 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44264 - DNA, 351 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaacaccatcaagcgcgtaccctgcgagacaccacccttcactctcagacctcaagaaagcaatcccccctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44265 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaactcctccctcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 44266 - DNA, 381 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggccttctgcttagtttgatgcctggcagtttatggcgggcataagacctcaagaaagcaaacccacctcactgcttcaaacgctccatcccacgctccttctcctcttcgacatcatcatctccccctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44267 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtccttacgggcctctgggtcatagcccacgagtgcggccaccacgccttcagcgactac

SEQ ID NO: 44268 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgagcctgccagggctgcgtcctaacgggcctctgggtcatcgcccacgaatgcggccaccacgccttcagcgactac

SEQ ID NO: 44269 - DNA, 306 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcaatcccacctcactgcttcaaacgctccatccctcgctccttctcctacctcctcttcgacatcctcgtctcctcctccctctaccacctccccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44270 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaaagctccatccctcgctccttctcctacctcctcttcgacatcctcgtctcctcctccctctaccacctctccacatcctacttccctctcctcccccaccctctcccttaccccgcctggcccctctactgggcctgccaaggctgcgtcctaacgggcctctgggtcatcgcccacgaatgcggccaccacgccttcagcgactac

SEQ ID NO: 44271 - DNA, 396 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccctcaaacgcgtcccctgcgagacaccaccattcactactgacagaaccgcaacgttgaaggagccactcagccgcgggtttctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44272 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccaccattcactctcaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44273 - DNA, 337 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccacccttaagaaagcaatcccacctcactgcttcaaacgctccatccctcgctccttctcctacctcctcttcgacatcctcgtctcctcctccctctaccacctctccacagcctacttccctctcctcccccacccgctcccttacctcgcctggcccctctactgggcctgccaaggctgcgtcctaacgggcctctgggtcatcgcccacgaatgcggccaccacgccttcagcgactac

SEQ ID NO: 44274 - DNA, 334 bp, Artificial
  Mutation in BnaC.FAD2.b introduced by TALE nuclease pair BnFAD2_T03
caggatccatgggtgcaggtggaagaatgcaagtttctcctccctccagctcccccggaaccaacaccctcaaacgcgtcccctgcgagacaccaccattcacaagacctcaagaaagcaatcccacctcactgcttcaaacgctccatcccacgctccttctcctcttcgacatcatcatctcctcctcggctcctccctctaccacctctccacagcctacttccctctcccttacctcgcctgaccccgctactgggcctgccaaggctgcgtcctaacgggcctctgggtcatagcccacgagtgcggccaccacgccttcagcgactac

SEQ ID NO: 44275 - DNA, 404 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttggcggcggcaggccggcgctggagagcattgttgcccagttatctcgccctgatccctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 44276 - DNA, 335 bp, Artificial
  Mutation in BnaC.FAD2.b introduced by TALE nuclease pair BnFAD2_T03
caggatccagggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44277 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaaccggcgtctgggtcatagcccacgagtgcggccaccacgccttcaggactac

SEQ ID NO: 44278 - DNA, 378 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcgcctgcttgccaccgccattgctggcgatggccaccacctttgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44279 - DNA, 332 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcacgaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44280 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccccccccggcccctctactgggcctgccaaggctgcgtcctaacgggcctctgggtcatcgcccacgaatgcggccaccacgccttcagcgactac

SEQ ID NO: 44281 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctccattacctcgcctgacccctctactgggcctgccaaggctgcgtcctaacgggcctctgggtcatagcccacgagtgcggccaccacgccttcagcgactac

SEQ ID NO: 44282 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctggggcatagcccacgagtgcggccaccacgccttcagcgactac

SEQ ID NO: 44283 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaaccggcgtctgggtcatagcccacgagtgcggccaccacgccttcagcgactac

SEQ ID NO: 44284 - DNA, 319 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgagcccccgatttagagcttgacggggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgctgccaccacgccttcagcgactac

SEQ ID NO: 44285 - DNA, 351 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctcagacctcaagaaaacaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44286 - DNA, 336 bp, Artificial
  Mutation in BnaC.FAD2.b introduced by TALE nuclease pair BnFAD2_T03
caggatccatgggtgcagggagaagaatgcaagtgtctcctccctccaaaaagtctgaaaccgacaacctcaagcgcgtaccctgcgagacaccaccattccctctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcagagcccacgagtgcggccaccacgccttcagcgactac

SEQ ID NO: 44287 - DNA, 333 bp, Artificial
  Mutation in BnaC.FAD2.b introduced by TALE nuclease pair BnFAD2_T03
caggatccatgggtgcaggtggaagaatgcaagaggctcctccctccagctcccccggaaccaacaccctcaaacgcgtcccctgcgagacaccaccattcactgacctcaagaaagcaagcccacctcacgacttcaaacgctccatcccactctccttctcctcttcgacatcatcatatcctcctcgcctcctccctctaccacctctccacagcctacttccctctcccttacctcacctgacccctctactgggcctgccaaggctgcgtcctaacgggcctcgggggtatagcccacgagtgcggccaccacgccatcaacaactac

SEQ ID NO: 44288 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcacctgcgagacaccaccattcactctagacctcaagaaagcaatcccacctcaccgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44289 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgaacctcaagaaagcaatcccacctcactgcttcaaacgctcctcccaacctccttctccttttcgacatcatcatctcctcctccgctcctccctctaccacctctccacagcctacttccctctccctttcctcgcctgacccctctactgggcctgccaaggctgcgtcctaacgggcctctgggtcatcgcccacgaatgcggccaccacgccttcagcgactac

SEQ ID NO: 44290 - DNA, 330 bp, Artificial
  Mutation in BnaC.FAD2.b introduced by TALE nuclease pair BnFAD2_T03
caggatccatgggcgcaggtggaagaatgcaagtctctcctccctccagctcccccggaaccaacaccctcaaacgcgtcccctgcgagacaccaccattcaccctcaagaaagcaatcccacctcactgcttcaaacgctccatcccaccctccttctcctcttcgacatcatcatctcctcctcggctcctccctctaccacctctccacagcctacttccctctcccttacctcccctgacccctctactgggcctgccaaggctgcgtcctaacgggcctctgggtcatagcccacgagtgcggccaccacgccttcagcgactac

SEQ ID NO: 44291 - DNA, 329 bp, Artificial
  Mutation in BnaC.FAD2.b introduced by TALE nuclease pair BnFAD2_T03
caggatccatgggtgcaggtgtaagaatgcaagtctctcctccctccagctcccccggaaccaacaccctcaaacgcgtcccctgcgagacaccaccattcactccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44292 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccacgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44293 - DNA, 348 bp, Artificial
  Mutation in BnaC.FAD2.b introduced by TALE nuclease pair BnFAD2_T03
caggatccatgggtgcaggtggaagaatgcaagtctctcatccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44294 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagcctgcgtcctaacgggcctctgggtcatagcccccgagggcgcccaccacgccttcagcgactcc

SEQ ID NO: 44295 - DNA, 349 bp, Artificial
  Mutation in BnaC.FAD2.b introduced by TALE nuclease pair BnFAD2_T03
caggatccatgggtgcaggtggaagaatgcaggtgtctcctccctccaaaaagtctgaaaccgacaacatcaagcgcgtaccctgcgagacaccgcccttcactgagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtaatcgcccacgaatgcggccaccacgccttcagcgactac

SEQ ID NO: 44296 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctatcccttacctcgcctggcccctctactgggcctgccaaggctgcgtcctaacgggcctctgggtcatcgcccacgaatgcggccaccacgccttcagcgactac

SEQ ID NO: 44297 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 44298 - DNA, 333 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44299 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagtccacgagtgcggccaccacgccttcagcgactac

SEQ ID NO: 44300 - DNA, 386 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggggtcaagccgtgggcctggcacagcaccggcaacagccgctggaccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaacgggcctctgggtcatcgcccacgaatgcggccaccacgccttcagcgactac

SEQ ID NO: 44301 - DNA, 335 bp, Artificial
  Mutation in BnaC.FAD2.b introduced by TALE nuclease pair BnFAD2_T03
caggatccatgggtgcaggtgaaagaatgcaagtctctcctccctccagctcccccgaaaccaaaacccccaaccgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44302 - DNA, 418 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcggatttgtcctactcaggagagcgttcaccgacaaacaacagataaaacgaaaggctcagtctttgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44303 - DNA, 324 bp, Artificial
  Mutation in BnaC.FAD2.b introduced by TALE nuclease pair BnFAD2_T03
caggatccatgggtgcaggtggaagaatgcaagtctctcctccaccaacaccctcaaacgcgtcccctgcgagacaccaccattcactctcgggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 44304 - DNA, 328 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactctagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 44305 - DNA, 323 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacacctacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 44306 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcactcagacctcaagaaagcaatcccacctcactgcttcaaacgctccatcccacgctccttctcctcttcgccatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44307 - DNA, 282 bp, Artificial
  Mutation in BnaC.FAD2.b introduced by TALE nuclease pair BnFAD2_T03
caggatccatgggtgcaggtggaagaatgcaagtctctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 44308 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatccctcgctccttctcctacctcctcttcgccatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44309 - DNA, 449 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacaccacctgctccggggtcaagccgtgggcctggcacagcaccggcaacagcgcctgcaccgtctccagcgcctgcttgccaccaatattgctggcgatggccaccacctgctccggagacctcaagaaagcaatcccacctcactgcttcaaacgccccctcccccgctccttccccccttcgacatcatcctcccctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44310 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 44311 - DNA, 334 bp, Artificial
  Mutation in BnaC.FAD2.b introduced by TALE nuclease pair BnFAD2_T03
caggatccatgggtgcaggtggaagaatgcaagtttctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactggtcctgccaaggctgcgtcctaacgggcctctgggtcatagcccacgagtgcggccaccacgccttcagcgactac

SEQ ID NO: 44312 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44313 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44314 - DNA, 432 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacggcgatggccaccacctgctccggggtcaagccgtgggcctggcacactccgggccgttgcttcacaacgttcaaatccgctcccggcggatttgtcctagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44315 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacttcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44316 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccacccttcactcccccaagcaagcagtcccacctccctgcttcaaactctccatccctcgctccttctcctacctcctcttcgacatcctcgtctcctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44317 - DNA, 326 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44318 - DNA, 351 bp, Artificial
  Mutation in BnaC.FAD2.b introduced by TALE nuclease pair BnFAD2_T03
caggatccatgggtgcaggtggaagaatgcaagtttctcctccctccagctcccccggaaccaacaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44319 - DNA, 411 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcggatttgtcctactcaggagagcgttcaccgacaaacaacagataaaacgaaaggctcagtctttgacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44320 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44321 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44322 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44323 - DNA, 335 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccaccattcactctgacctcaagaaagcaatcccacctcactgcttcaaacgctccatcccacgctccttctcctattcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44324 - DNA, 340 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtcccctgcgagacaccaccgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44325 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 44326 - DNA, 347 bp, Artificial
  Mutation in BnaC.FAD2.b introduced by TALE nuclease pair BnFAD2_T03
caggatccatgggtgcaggtcgaagaatgcaagtctctcctccctccagctcccccgaaaccaaaaccctcaaacgcgtcccctgcgagacaccaccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44327 - DNA, 320 bp, Artificial
  Mutation in BnaC.FAD2.b introduced by TALE nuclease pair BnFAD2_T03
caggatccatggtgcaggtggaagaatgcaagtctctcctccctccagctcccccgaaaccaaaaccctcaaacgcgtcccctgcgagacaccacccttcactctcagacctcaagaaagcaatcccacctcactgcttcaaacgctccatccctcgctccttctcctacctcctcttcgacatcctcgtctcctcctccctctaccacctctccacagcctacttcgcctggcctctctactgggcctgccagggctgcgtcctaaccggcgtctgggtcatagcccacgagtgcggccaccacgccttcagcgactac

SEQ ID NO: 44328 - DNA, 460 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctctccagcgcctgcttgccgccatcgtggctggcgatggccaccacctgctccggggtcaagccgtgggcctggcacagcaccggcaacagccgctggaccgtctccagcgcctgttgccgccagagacctcaagaaagcaatcccacctcactgctccaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44329 - DNA, 370 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcggcgggtgtggtggttacgcgcaaagacctcaagaaagcaatcccacctcactgcttcaaacgctccatccccccctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44330 - DNA, 346 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactccatcccacgctccttctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44331 - DNA, 335 bp, Artificial
  Mutation in BnaC.FAD2.b introduced by TALE nuclease pair BnFAD2_T03
caggatccatgggtgcaggtggaagaatgcaagtctatccaccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44332 - DNA, 401 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagagcggatttgtcctactcaggagagcgttcaccgacaaacaacagataaaacgaaaggctcagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44333 - DNA, 371 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggaagagtttgtagaaacgcaaaaaggccatccgtcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44334 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44335 - DNA, 329 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccaccagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44336 - DNA, 337 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccaccattcacctggagacctcaagaaagcaatcccacctcactgcttcaaacgctccaccccacgctccttctcctcttcgacctcatcatctcctcctcgcctcctccctctaccacctctccacagcctacttccctctcccttacctcgcctggcccctctactgggcctgccaagggtgcgtcctaacgggcctctgggtcatcgcccacgaatgcggccaccacgccttcagcgactac

SEQ ID NO: 44337 - DNA, 333 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactgacctcaagaaagcaatcccacctcactgcttcaaacgctccatcccacgctccttctcctcttcgacatcatcatctcctcctcggctcctccatctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44338 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcaactac

SEQ ID NO: 44339 - DNA, 324 bp, Artificial
  Mutation in BnaC.FAD2.b introduced by TALE nuclease pair BnFAD2_T03
caggatccatgggtgcaggtggaagaatgcaagtatatactccctccagctcccccggaaccaacaccctcaaacgcgtcccctgcgagacaccaccactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44340 - DNA, 335 bp, Artificial
  Mutation in BnaC.FAD2.b introduced by TALE nuclease pair BnFAD2_T03
caggatccatgggtgcaggtggaagaatgcaagtctctcctcccttcagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctgcttccctctcccttacctcgcctgacccctctactgggcctgccaatgctgcgtcctaacgtgcctctgggtcatagcccacgagtgcggccaccacgccttcagcgactac

SEQ ID NO: 44341 - DNA, 349 bp, Artificial
  Mutation in BnaC.FAD2.b introduced by TALE nuclease pair BnFAD2_T03
caggatccatgggtgcagggggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacgtcctacttccctctcctcccccaccctctcccttacctcgcctggcccctctactgggcctgccaaggctgcgtcctaaccggcctctgggtcatagcccacgagtgcggccaccacgccttcagcgactac

SEQ ID NO: 44342 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44343 - DNA, 404 bp, Artificial
  Mutation in BnaC.FAD2.b introduced by TALE nuclease pair BnFAD2_T03
caggatccatgggtgcaggtggaagaatgcaagtctctcatccctccagctcccccgaaaccaaaaccctcaaacgcgtcccctgcgagacaccacccttcactctcggcggatttgtcctactcaggagagcgttcaccgacaaacaacagataaaacgaaaggctcagtctttgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44344 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctaggtcatagcccacgagtgcggccaccacgccttcagcgactac

SEQ ID NO: 44345 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44346 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactctaagacctcaagaaagcaatcccacctcactgcttcaagcgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 44347 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcctcccccaccctctccattccctcgcctggcccctctactgggcctgccaaggctgcgtcctaacgggcctctgggtcatagcccacgagtgcggccaccacgccttcagcgactac

SEQ ID NO: 44348 - DNA, 349 bp, Artificial
  Mutation in BnaC.FAD2.b introduced by TALE nuclease pair BnFAD2_T03
caggatccatgggcgcaggtggaagaatgcaagtgtctcctccctccaagaagtctgaaaccgacaccatcaagcgcgtaaccccagcaggtggtgaccatcgccagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44349 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagcctgcgtcctagcgggcctctgggtcatcgcccacgaatgcggccaccacgccttcagcgactac

SEQ ID NO: 44350 - DNA, 442 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccgtccagcggctgttgccggtgctgtgccaggcccacggcttgaccccggagcaggtggtggccatcgccagccacgatggcggcaagcaggcgctggagagagacctcaagaaagcaatcccacctcactgcttcaaacgctccatccctcgctccttctcctacctcctcttcgacatcctcgtctccgcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 44351 - DNA, 294 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 44352 - DNA, 319 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44353 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44354 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcataaccggcgtctgggtcatagcccacgagtgcggccaccacgccttcagcgactac

SEQ ID NO: 44355 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 44356 - DNA, 326 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgttcggctgcggcgagcggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44357 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccaccacaccccttcaaactctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 44358 - DNA, 342 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 44359 - DNA, 341 bp, Artificial
  Mutation in BnaC.FAD2.b introduced by TALE nuclease pair BnFAD2_T03
caggatccataggtgcaggtggaagaatgcaagtctctcctccctccagctcccccggaaccaacaccctcaaacgcgtcccctgcgagacaccaccattcacttagacctcaagaaagcaatcccacctcactgcttcaaacgctccatcccacgctccttctcctcttcgacatcctcgtctcctcctccctctaccacctctccacagcctacttccctctcctccccccccctctcccttacctcgccggcccctctactgggcctgccaagggtgcgtcctaaccggcgtctgggtcatagcccacgagtgcggccaccacgccttcagcgactac

SEQ ID NO: 44360 - DNA, 373 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactatcaggggataacgcaggaaagaacatgtgagcaaaaggccagcaaatctaccacctcactgcttcaaacgctccatcccacgctccttctcctcttcgacatcctcgtctcctcctccctctaccacctctcaacagcctacttccctctccccccccaccctctcccttacctcgcctggcccctctactgggcctgccaaggctgcgtcctaacgggcctctgggtcatcgcccacgaatgcggccaccacgccttcagcgactac

SEQ ID NO: 44361 - DNA, 354 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44362 - DNA, 349 bp, Artificial
  Mutation in BnaC.FAD2.b introduced by TALE nuclease pair BnFAD2_T03
caggatccatgggtgcaggtagaagaatgcaagtctctcctccctccagctcccccgaaaccaaaaccctcaaacgcgtcccctgcgagacaccacccttcactcagacctcaagaaagcaatcccaccacactgcctcaaacgctccatccctcgcgctctcacctacctcctcttcgccatcatcgtctcctcctccctctactacctctccacatcctacttccctcccctccccccccccctcccttacctcccctggcccctctactgagcatgccaaggctgcttcctaacgggcctcggggtcagcgcctacaagtgcggcctccacgccttcagcgactac

SEQ ID NO: 44363 - DNA, 348 bp, Artificial
  Mutation in BnaC.FAD2.b introduced by TALE nuclease pair BnFAD2_T03
caggatccatgggtgcaggtggaagaatgcaagtctctcctcactccagctcccccggaaccaacaccctcaaacgcgtcccctgcgagacaccaccattcactagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44364 - DNA, 357 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactctccgccggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 44365 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcggggtcatcgcccacgagtgcggccaccacgccttcagcgactac

SEQ ID NO: 44366 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 44367 - DNA, 334 bp, Artificial
  Mutation in BnaC.FAD2.b introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactcaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaggactgcgtcctagcgggcctctgtgtcatagccctcgagcgcggccaccacgccttcagccactcc

SEQ ID NO: 44368 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 44369 - DNA, 350 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccatcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44370 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccacctcactgcttcaaacgctccatccctcgctccttctcctacctcctcttcgacatcctcgtctcctcctccctctaccacctctccacagcctacttccctctcccttacctcgcctgtcccctctactgggcctgccaaggctgcgtcctaacgggcctctgggtcatagcccacgagtgcggccaccacgccttcagcgactac

SEQ ID NO: 44371 - DNA, 418 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcggatttgtcctactcaggagagcgttcaccgacaaacaacagataaaacgaaaggctcagtctttgacctcaagaaagcaatcccacctcactgcttcaaacgctccatccctcgctccttctcctacctcctcttcgacatcctcgtctcctcctccctctaccacctctccacagcctacttccctcgcctcccccaccctctcccttacctcgcctggcccctctactgggcctgccaaggctgcgtcctaacgggcctctgggtcatcgcccacgaatgcggccaccacgccttcagcgactac

SEQ ID NO: 44372 - DNA, 347 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcctcaagaaagcaattccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44373 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 44374 - DNA, 454 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggaccgtctcagcggctgttgccaccgccattgctggcgatggccaccacctgctggtagcggtggtttttttgtttgcaagcagcagattacgcgcagaaggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44375 - DNA, 344 bp, Artificial
  Mutation in BnaC.FAD2.b introduced by TALE nuclease pair BnFAD2_T03
caggatccatgggtgcaggtggaagaatgcaagtctatcctccctccaagaagtctgaaaccgacaccatcaagcgcgtaccctgcgagacaccgcccttcagactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44376 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44377 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44378 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctcaactgggcctgccaaggctgcgtcctaacgggccactgggtcatagcccacgagtgcggccaccacgccttcagcgactac

SEQ ID NO: 44379 - DNA, 327 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacacccccagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44380 - DNA, 279 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttcgacatcctcgtctcctcctccctctaccacctctccacagcctacttccctctcctcccccaccctctcccttacctcgcctggcccctctaccgggcctgccaaggctgcgtcctaacgggcctctgggtcatcgcccacgaatgcggccaccacgccttcagcgactac

SEQ ID NO: 44381 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44382 - DNA, 385 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggcctacaccgctgtgaagtgctccaccccgtaggtcggataaggcggttacgccttatccaacctaccgagacctcaagaaagcaatcccacctcactgcttcaaactctccatcccacgctccttctcctcttcgacatcatcatctccccctcggctcctcccccaccctctcccttacctcgcctggcccctctacagggcctgccaaggctgcgtcctaacgggcctctgggtcatagcccacgaatgcggccaccacgccttcagcgactac

SEQ ID NO: 44383 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcaatcccacctcactgcttcaaacgctccatccctcgctccttctcctacctcctcttcgacatcctcgtctcctcctccctctaccacctctccacagcctacttccctctcctccctcaccctctcccttacctcgcctggcccctctactgggcctgccagggctgcgtcctaaccggcgtctgggtcatagcccacgagtgcggccaccacgccttcagcgactac

SEQ ID NO: 44384 - DNA, 333 bp, Artificial
  Mutation in BnaC.FAD2.b introduced by TALE nuclease pair BnFAD2_T03
caggatccagggtgcaggtggaagaatgcaagtctctcctccctccagctcccccgaaaccaaaaccctcaaacgcgtcccctgcgagacaccaccattcacttgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44385 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44386 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccgcccgagacctcaagaaagcaatcccacctcactgcttcaaacgctccatcccacgctccttctcctcttcgacatcatcatctcctcctcggctcctccctctaccacccctccacagcctacttccctctcccttacctcgcctgacccctctactgggcctgccaaggctgcgtcctaacgggcctctgggtcatagcccacgagtgcggccaccacgccttcagcgactac

SEQ ID NO: 44387 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttccctcgcctgccccctctactgggcctgccaaggctgcgtcctaacgggcctctgggtcatagcccacgagtgcggccaccacgccttcagcgactac

SEQ ID NO: 44388 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctctccgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44389 - DNA, 349 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44390 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactctcacctcaatcaagcaatcccacctcactccttcaaacactccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 44391 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacaagacctcaagaaagcaatcccacctcactgcttcaaacgctccatcccacgctccttctcctcttcgacatcatcatctcctcctcgactcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44392 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 44393 - DNA, 419 bp, Artificial
  Mutation in BnaC.FAD2.b introduced by TALE nuclease pair BnFAD2_T03
caggatccatgggtgcaggtggaagaatgcaagtgacacaaccctccagctcccccgaaagcaaaagaagaaaaggagtccccggagagacaccaccctgaactacggaccagaggctgtcgccgccaaaggggctggcgatggccacaacccgccccggggacaagccgtgggcagacctcaagaaagcaatcccacctcactgcttcaaacgctccatccctcgctccttctcctacctcctcttcgacatcctcgtctcctcctccctctaccccctcgccacagcctacttccctctccccccccaccctctcccttacctcgcctggcccctctactgggcctgccaaggctgcgtcctaacgggcctctgggtcatcgcccacgaatgcggccaccacgccttcagcgactac

SEQ ID NO: 44394 - DNA, 336 bp, Artificial
  Mutation in BnaC.FAD2.b introduced by TALE nuclease pair BnFAD2_T03
caggatccatgggtgcaggtggaagaatgcaagtctatcctccctccagctcccccgaaactaaaaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44395 - DNA, 308 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacactggagacggtctcgatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 44396 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44397 - DNA, 439 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgtccagcggctgttgccggtgctgtgccaggcccacggcttgaccccggagcaggtggtggccatcgccagcaatattggtggcaagcaggcgctggcacaaagaccccaagaaagcaatcccacctcactgcttcaaacgctccatcccacgctccttctcctcttcgacatcatcatctcctcctcggctcctccctctcccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 44398 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaacgggcctctgggtcatcgcccacgaatgcggccaccacgccttcagcgactac

SEQ ID NO: 44399 - DNA, 350 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacacaatcaagcgcgtaccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44400 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccagggctgcgtcctaaccggcctctgggtcatagcccacgagtgcggccaccacgccttcagcgactac

SEQ ID NO: 44401 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcagctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44402 - DNA, 372 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagcggctgttgccggtgctgtgccaggcccccgctcaatcccacctcactgcttcaaacgctccatccctcgctccttctcctacctcctcttcgacatcctcctctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 44403 - DNA, 349 bp, Artificial
  Mutation in BnaC.FAD2.b introduced by TALE nuclease pair BnFAD2_T03
caggatccatgggtgcaggtagaagaatgcaagtctctcctccctacagctcccccgaaaccaaaaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44404 - DNA, 382 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgggtcaagccgtgggcctggcacagccccggcaagcaggcgctggagagacctcaagaaagcaatcccacctcactgcttcaaacgctccatcccacgctccttctcctcttcgacatcatcatctcctcctcggctcctccctctaccacctctccacagcctacttccctctcccttacctcgccttacccctctactgggcctgccaaggctgcgtcctaacgggcctctgggtcatcgcccacgaatgcggccaccacgccttcagcgactac

SEQ ID NO: 44405 - DNA, 335 bp, Artificial
  Mutation in BnaC.FAD2.b introduced by TALE nuclease pair BnFAD2_T03
caggatccatgggtgcaggtggaagaatgcaagtctctcctccctccagctaccccggaaccaacaccctcaaacgcgtcccctgcgagacaccaccattcactcagacctcaacaaagcaatcacacctcactgcttcaaacgctccatcccaccctccttctcctcttcgacatcatcccctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 44406 - DNA, 325 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaagacctcaagaaagcaatcccacctcactgcttcaaacgctccatcccacgctccttctcctcttcgccatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44407 - DNA, 346 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccattcactgtcgcgacgcggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44408 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44409 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactggttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44410 - DNA, 383 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgagcgccatctcgaaccgacgttgccggccgagacctcaagaaagcaatcccacctcactgcttcaaacgccccatcccacgccccttctcctcttcgacaccatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44411 - DNA, 331 bp, Artificial
  Mutation in BnaC.FAD2.b introduced by TALE nuclease pair BnFAD2_T03
caggatccatgctttcaggtggaagaatgcaagtctatcctccctccacctccacccaaaccaaaaccctcaaacgcgtcccctgcgagacaccacccttcacgacctcaagaaagcaatcccacctcactgcttcaaactctccctccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44412 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgtgtcatcgcccacgaatgcggccaccacgccttcagcgactac

SEQ ID NO: 44413 - DNA, 321 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccataaaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 44414 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcctcgtctcctcctccctctaacacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44415 - DNA, 334 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44416 - DNA, 312 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcacgactac

SEQ ID NO: 44417 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgtcaaggctgcgtcctaacgggcctctgggtcatagcccacgagtgcggccaccacgccttcagcgactac

SEQ ID NO: 44418 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattaactcagacctcaagaaagcaatcccacctcactgcttcaaacgctccatcccacgctccttctcctcttcgacatcatcatctcctcctcggctcctccctctaccacctctccacagcctacttccctctcacttacctcgcctgacccctctactgggcctgccaaggctgcgtcctaacgggcctctgggtcatagcccacgagtgcggccaccacgccttcagcgactac

SEQ ID NO: 44419 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaacgggcctctgggtcatcgcccacgaatgcggccgccacgccatcagcgactac

SEQ ID NO: 44420 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacacacctcaagaaagcaatcccacctcactgcttcaaacgctccatccctcgctccttctcctacctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 44421 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaattcggccaccacgccttcagcgactac

SEQ ID NO: 44422 - DNA, 333 bp, Artificial
  Mutation in BnaC.FAD2.b introduced by TALE nuclease pair BnFAD2_T03
caggatccatgggtgcaggtggaagaatgcaagtgtctcctccctccagctcccccgaaccaacaccctcaaacgcgtcccctgcgagacaccaccattcactctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 44423 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactctcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 44424 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccgaaacaaaaacccccaaacccgtcccctgcgagacaccgcccttaactcaagaaagctatcccacctcactgcttcaaactctccctcccacgctccttctcctcttcgccatcaccttctcctcctcgtctcctccccctcccacctctccacagcctccttccctctcccttacctcgcctgacccctctactgggcctgccaagggtgcgtcctaacgggcgtctgggtcatagcccacgagtgcggccaccacgccttcagcgactac

SEQ ID NO: 44425 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacaagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44426 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggccttccaaggctgcgtcctaaccggcgtctgggtcatagcccacgagtgcggccaccacgccttcagcgactac

SEQ ID NO: 44427 - DNA, 432 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactccagcggctgttgccggtgctgtgccaggcccacggcttgaccccggagcaggtggtggccatcgccagccacgatggcggtggagaactcaagaaagcaatcccaccgcactgtttcaaacgctcgatccctcgctctttctcctacctcctctccgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 44428 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggccactctactgggcctgccaaggctgcgtcctaacgggcctctgggtcatcgcccacgaatgcggccaccacgccttcagcgactac

SEQ ID NO: 44429 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44430 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 44431 - DNA, 335 bp, Artificial
  Mutation in BnaC.FAD2.b introduced by TALE nuclease pair BnFAD2_T03
caggatccatgtgtgcaggtggaagaatgcaagtctctcctccctccagctcccccggaaccaacaccctcaaacgcgtcccctgcgagacaccaccattcactcggacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44432 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcacctcaagaaagcaatcccacctcactgcttcaaacgctccatcccacgctccttctcctcttcgacatcatcatctcctcctctgctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 44433 - DNA, 281 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44434 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagcaagcaatcccacctcactgcttcaaacgctccatcccaccctccttctcctcttcgacatcatcatctcctcctcggctcctccctctaccacctctccacagcctccttccctctcccttacctcgcctggcccctctactgggcctgccaaggctgcgtcctaacgggcctctgggtcatagcccacgagtgcggccaccacgccttcagcgactac

SEQ ID NO: 44435 - DNA, 404 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgcaattaatacgcgtaccgctagccaggaagagtttgtagaaacgcaaaacggagacctcaagaaagcaatcccacctcactgcttcaaacgctccatccctcgctccttctcctacctcctcttcgacatcctcgtctcctcctccccctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44436 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctcggcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 44437 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaacgggcctctgggtcatcgcccacgaatgcggccaccacgccttcagcgactac

SEQ ID NO: 44438 - DNA, 337 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgctgccaccacgccttcagcgactac

SEQ ID NO: 44439 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatccaacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44440 - DNA, 419 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcaacagccgctggaccgtctccagcgcctgcttgccaccattattgctggcgatggccaccacctgccatcccacgttccagacctcaagaaagcaatcccacctcactgcttcaaacgctccatcccacgctccttctcctcttcgacaccatcatctcctcctcggctcctccctctaccacctctccacagcctacttccctctccctgacctcgcctgacccctctactgggcctgccaaggctgcgtcctaacgggcctctgggtcatagcccacgagtgcggccaccacgccttcagcgactac

SEQ ID NO: 44441 - DNA, 467 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctggcgatggccaccacctgctccggggtcaagccgtgggcctggcacagcaccggcaacagccgctggaccgtctccagcgcctgcttgccaccattattgctggcgatgaaagacctcaagaaagcaatcccacctcactgcttcaaacgctccatcccccgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctcttggtcatcgcccacgaatgcggccaccacgccttcagcgactac

SEQ ID NO: 44442 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccacctcactgcttcaaacgatccatcccaccctccttctcctcttcgacatcatcatctcctcctcggctcctccctctaccacctctccacagcctactcccctctcccctacctcccctgacccctctactgggcctgccaaggctgcgtcctaacggggctctggggcatagcccacgagtgcggccaccacgccttcagcgactac

SEQ ID NO: 44443 - DNA, 337 bp, Artificial
  Mutation in BnaC.FAD2.b introduced by TALE nuclease pair BnFAD2_T03
caggatccatgggtgcaggtggaagaatgcaagtgtctcctcactccaagaagtctgaaaccgacaccatcaagcgcgtaccctgcgagacaccgcccttcactgcaagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44444 - DNA, 263 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44445 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 44446 - DNA, 379 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgaacgctctcctgagtaggacaaatccgctccctcaagaaagcaatcccacctcactgcttcaaacgctccatccctcgctccttctcctacctcctcttcgccatcctcgtctcctcctccctctaccacctctccacagcctacttccccctccccccccaccctctcccttacctcgcctggcccctctactgggcctgccaaggctgcgtcctaacgggcctctgggtcatcgcccacgaatgcggccaccacgccttcagcgactac

SEQ ID NO: 44447 - DNA, 391 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccagcgcctgcttgccaccattattgctggcgatggccaccacctgctggggggtcaagttgagcggggcacccgtcagtgcattgcgccagagacctcaagaaagcaatcccacctcactgcttcaaacgctccatccctcgctccttctcctacctcctcttcgacatcctcgtctcctcctccctctcccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 44448 - DNA, 361 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccatggcggtggcaagcaggcgctggagagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44449 - DNA, 371 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggaagagtttgtagaaacgcaaaaaggccatccgtcagacctcaagaaagcaatcccacctcactgcttcaaacgctccatcccacgctccttctcctcttcgacatcatcatctcctcctcggctcctccctctaccacctctccacagcctccttccctcccccttacctcgcctgacccctctactgggcctgccaaggctgcgtcctaacgggcctctgggtcatagcccacgagtgcggccaccacgccttcagcgactac

SEQ ID NO: 44450 - DNA, 346 bp, Artificial
  Mutation in BnaC.FAD2.b introduced by TALE nuclease pair BnFAD2_T03
caggatccatgggtgcaggtgcaagaatgcaagtgtctcctccctccaagaagtctgaaaccgacaccatcaagcgcgtaccctgcgagacaccaccattcactccatcccacactccttctcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44451 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtcacctcctccctctaccacctctccacagcctacttccctctcctccccccccctctcccttacctcccctggcccctctactgggcctgccaaggctgcgtcctaacgggcctctgggtcatcgcccacgaatgcggtcaccacgccttcagcgactac

SEQ ID NO: 44452 - DNA, 343 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctcggtcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44453 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctccctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44454 - DNA, 331 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 44455 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccctccactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgccccctctactgggcctgccaaggctgcgtcctaacgggcctctgggtcatagcccacgagtgcggccaccacgccttcagcgactac

SEQ ID NO: 44456 - DNA, 330 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccaagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcagagcccacgagcgcggccaccacgccttcagcgactac

SEQ ID NO: 44457 - DNA, 351 bp, Artificial
  Mutation in BnaC.FAD2.b introduced by TALE nuclease pair BnFAD2_T03
caggatccatgggtgcaggtcgaagaatgcaagtctctcctccctccagctcccccggaaccaacaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 44458 - DNA, 322 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctatactgggcctgccaaggctgcgtcctaacgggcctctgggtcatagcccacgagtgcggccaccacgccttcagcgactac

SEQ ID NO: 44459 - DNA, 352 bp, Artificial
  Mutation in BnaC.FAD2.b introduced by TALE nuclease pair BnFAD2_T03
caggatccatgggtgcaggtggaagaatgcaagtgtatcctccctccaagaagtctgaaaccgacaccatcaaacgcgtcccctgcgagacaccacccttcactctcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44460 - DNA, 354 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagcaatggcggtggctggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44461 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgcttcaaacgcaccatcccacgcgccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44462 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44463 - DNA, 394 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttggccaccacctgctccggggtcaagctggaggggtacaccttccaccactcgttgggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44464 - DNA, 429 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcactgccaggcgtcaaactaagcagaaggccatccgtctccagcgcctgttgccggtgctgtgccaggcccacggcttgaccccggagcaggtggagacctcaagaaagcaatcccacctcactgcttcaaacgctccatcccacgctccttctcctcttcgacatcaccatcccctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44465 - DNA, 329 bp, Artificial
  Mutation in BnaC.FAD2.b introduced by TALE nuclease pair BnFAD2_T03
caggaccatgggtgcaggtggaagaatgcaattctctcctccctccagctcccccggaaccaacaccctcaaacgcgtcccctgcgagacaccaccattcaccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44466 - DNA, 303 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44467 - DNA, 409 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactctcgacttcgctgctacccaaggttgccccacgagtacatcgagctgatcgagatcgcccggaacagcacccaagagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44468 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccacctcactgcttcaaacgctccatccctcgctccttctcctacctcctcttcgacatcctcgtctcctcctccctctaccacctctccacagcctacttccctctcctccccaccctctcccttacctcgcctggcccctctactgggcctgccaaggctgcgtcctaacgggcctctgggtcatcgcccacgaatgcggccaccacgccttcagcgactac

SEQ ID NO: 44469 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctccgagacaccaccattcactctagacctcaagaaagcaatcccacctcactgctccaaacgctccatcccaccctccttctcctacctcctcttcgacatcctcgtctcctcctccctctaccaccactccacagcctacttccctctcccttacctcgcctgacccctctactgggcctgccaaggctgcgtcctaacgggcctctgggtcatagcccacgagtgcggccaccacgccttcagcgactac

SEQ ID NO: 44470 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacaggcctctgggtcatcgcccacgaatgcggccaccacgccttcagcgactac

SEQ ID NO: 44471 - DNA, 389 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagtcctgtcgggtttcgccacctctgacttgagcgtcgatttttgtgatgctcgtagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44472 - DNA, 336 bp, Artificial
  Mutation in BnaC.FAD2.b introduced by TALE nuclease pair BnFAD2_T03
caggatccatgggtgcaggtggaagaatgcaagtctctcctccccccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44473 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgcctggcccctctactgggcctgccaaggctgcgtcctagcgggcctctgggtcatcgcccacgaatgcggccaccacgccttcagcgactac

SEQ ID NO: 44474 - DNA, 280 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatccctcgctccttctcctacctcctcttcgacatcctcgtctcctcctccctctaccacctctccacagcctacttccctctcctcccccaccctcccccttacctcgcctggcccctctactgggcctgccaaggctgcgtcctaacgggcctctgggtcatcgcccacgaaggcggccaccacgccttcagcgacctac

SEQ ID NO: 44475 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44476 - DNA, 439 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgtccagcggctgttgccggtgctgtgccaggcccacggcttgaccccggagcaggtggtggccatcgccagcaatattggtggcaagcaggcgctggcacaaatacctcaagaaagcaatcccacctcactgcttcaaacgctccaccccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44477 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44478 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccccaagaaagcaatcccacctcactgcttcaaacgctccatcccacgctccttctcctcttcgacatcatcatctcctcctcggctcctccctctaccacctctccacagcctacttccctctcccctacctcgcctgacccctctactgggcctgccaaggctgcgtcctaacgggcctctgggtcatagcccacgagtgcggccaccacgccttcagcgactac

SEQ ID NO: 44479 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44480 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccgtcagcgactac

SEQ ID NO: 44481 - DNA, 279 bp, Artificial
  Mutation in BnaC.FAD2.b introduced by TALE nuclease pair BnFAD2_T03
caggatccatgggtgcaggtggaagaatgcaagtctctcctccctccagtctctccacctcactgcttcaaacgctccatccctcactccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44482 - DNA, 331 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccaccattcacacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagccactac

SEQ ID NO: 44483 - DNA, 355 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgggaagacctcaagaaagcaatcccacctcactgcttcaaacgctccatccctcgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44484 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44485 - DNA, 387 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaaagctggtttgcatgcaggcctctgcagtcgacgggcccgggatccgaagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44486 - DNA, 369 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgaggcccacggcttgaccccggagcaggtggtggccatcgccagccacgatggagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44487 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccggagacctcgagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44488 - DNA, 328 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtccccacgcgtcccagcaatggcggtggcaagcaggcgctggagacctcaagaaagcaatcccacctcactgcttcaaacgctccatccctcgctccttctcctcttcgacatcatcatctcctcctcggctcctccctcaccctctctcctacttcgcctggcttctctactgggcctgccaagggtgcgtcctaaccggcgtctgggtcatagcccacgagtgcggccaccacgccttcagcgactac

SEQ ID NO: 44489 - DNA, 428 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttgcgcgtaaccaccacacccgccagcgccctagcgcccgctcctttcgctttcttcccttcctttctcgccacgttcgagaactcaagaaagcaatcccaccgcactgtgtcaaacgctcgatccctcgctctttctcctacctccgctgcgacatcctcgtctcctccgccctctaccacctcaccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44490 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttacagcgagcgatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 44491 - DNA, 351 bp, Artificial
  Mutation in BnaC.FAD2.b introduced by TALE nuclease pair BnFAD2_T03
caggatacatgggtgcaggtgcaagaatgcaagtctctcctccatccagctcccccgaaaccaaaaccctcaaacgcgtcccctgcgagacaccacccttcactctcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctggttcatctcccacgaatgcggccaccacgccttcagcgactac

SEQ ID NO: 44492 - DNA, 304 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccacccttcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44493 - DNA, 264 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcatctactac

SEQ ID NO: 44494 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 44495 - DNA, 308 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44496 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctcctcccccaccctctcccttacctcgcctggcccctctactgggcctgccagggctgcgtcctaacgggcctctgggtcatcgcccacgagtgcggccaccacgccttcagcgactac

SEQ ID NO: 44497 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44498 - DNA, 268 bp, Artificial
  Mutation in BnaC.FAD2.b introduced by TALE nuclease pair BnFAD2_T03
caggatccatgggtgcaggtggaagaatgcaagtctctagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44499 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgctagacaccaccattcactctagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcatgccaaggctgcgtcctaacgggcctctgggtcatcgcccacgaatgcggccaccacgccttcagcgactac

SEQ ID NO: 44500 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcttcccctgcgagacaccaccattcactcgagacctcaagaaagcaatcccacctcactgcttcaaacgctccatcccacgctccttctcctcttcgacatcatcatctcctcctcggctcctccctctaccacctctccaaagcctacttccctctcccttacctcgcctgacccctctactgggcctgccaaggctgcgtcctaaccggcgtcggggtcatagcccacgagtgcggccaccacgccttcagcgactac

SEQ ID NO: 44501 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgagtcccctgcgagacaccaccattcactcttacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 44502 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgggaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44503 - DNA, 336 bp, Artificial
  Mutation in BnaC.FAD2.b introduced by TALE nuclease pair BnFAD2_T03
caggatccatgggtgtaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44504 - DNA, 335 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccaccattcacggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaattcggccaccacgccttcagcgactac

SEQ ID NO: 44505 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcgaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44506 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccatcacgccttcagcgactac

SEQ ID NO: 44507 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattctcaagaaagcaatcccacctcactgcttcaaactctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44508 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgtgtcatagcccacgagtgcggccaccacgccttcagcgactac

SEQ ID NO: 44509 - DNA, 322 bp, Artificial
  Mutation in BnaC.FAD2.b introduced by TALE nuclease pair BnFAD2_T03
caggatccatgggtgcaggtgcaagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44510 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44511 - DNA, 393 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagccgaacgaccgagcgcagcgagtcagtgagcgaggaagcggaagagcgcccaatacgcggagacctcaagaaagcaatcccacctcactgcttcaaacgctccatcccacgctccttctcctcttcgacatcatcatctcctcctcggctcctcccgctaccacctctcctcccccaccctctcccttacctcgcctggcccctctactgggcctgccaagggtgcgtcctaaccggcgtctgggtcatagcccacgagtgcggccaccacgccttcagcgactac

SEQ ID NO: 44512 - DNA, 335 bp, Artificial
  Mutation in BnaC.FAD2.b introduced by TALE nuclease pair BnFAD2_T03
caggatccatgggtgcaggcggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44513 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctctcaagaaagcaatcccacctcactgcttcaaacgctccatccctcgctccttctcctacctcctcttcgacatcctcgtctcctcctccctctaccacctcgccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44514 - DNA, 342 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44515 - DNA, 419 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcaacagccgctggaccgtctccagcgcctgcttgccaccattattgctggcgatggccaccacctgccatcccacgttccagacctcaagaaagcaatcccacctcactgcttcaaacgctccatcccacgctccttctcctcttcgacatcaccatcccctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44516 - DNA, 336 bp, Artificial
  Mutation in BnaC.FAD2.b introduced by TALE nuclease pair BnFAD2_T03
caggatccatgggtgcaggtggaagaatacaagtctctcctccctccagctcccccggaaccaacaccctcaaacgcgtcccctgcgagacaccaccattcactaaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44517 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 44518 - DNA, 339 bp, Artificial
  Mutation in BnaC.FAD2.b introduced by TALE nuclease pair BnFAD2_T03
caggatccatgggtgcaggtggaagaatgcaagtctttcctccctccagctcccccgaaaccaaaaccctcaaccgcgtcccctgcgagacaccacccttcactctcggcttcactgcttcaaacgctccatccctcgctccttctcctccctcctcttcgacatcctcgtctcctcctcggctcctccctctaccacctctccacagcgtacttccctctcctcccccacccgcgcccttacctcgccaggcccctctacggggcctgccaaggctgcgtcctaacgggcctcggggtcagcgcccacgaatgctgccaccgcgccttcagcgactac

SEQ ID NO: 44519 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44520 - DNA, 265 bp, Artificial
  Mutation in BnaC.FAD2.b introduced by TALE nuclease pair BnFAD2_T03
caggatccatgggtgcaggtggaagaatgcaagtctctcctcactccagtctctccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44521 - DNA, 346 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgcgacgcggagaactcaagaaagcaatcccacctcactgcttcaaacgctccatcccacgctccttctcctcttcgacatcatcatctcctcctcggctcctccctctaccacctctacacagcctacttccctctcccttacctcgcctgacccctctactgggcctgccaaggctgcgtcctaacgggcctctgggtcatagcccacgagtgcggccaccacgccttcagcgactac

SEQ ID NO: 44522 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 44523 - DNA, 329 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44524 - DNA, 272 bp, Artificial
  Mutation in BnaC.FAD2.b introduced by TALE nuclease pair BnFAD2_T03
caggatccatgggagcaggtggaagaatgcaagtctctcctccctccagctcccccggaaccaacaacctcaaacgcgtcccctgcgagacaccaccattcactctcctcctcggctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 44525 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatcccacgccccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44526 - DNA, 347 bp, Artificial
  Mutation in BnaC.FAD2.b introduced by TALE nuclease pair BnFAD2_T03
caggatccatgggtgcaggtcgaagaatgcaagtctctcctccctccagctcccccgaacccaaaaccctcaaacgcgtcccctgcgagacaccacccttcactctcctcaagaaagcaatcccacctcactgcttcaaacgctccatccctcgctccttctcctacctcctcttcgacatcctcgtctcctcctccctctaccaccactccacagcctacttccctctcctcccccaccctcgcccttacctcgcctggcccctctactgggcctgccaaggctgcgtcctaacgggcctctgggtcatcgcccacgaatgcggccaccacgccatcagcgactac

SEQ ID NO: 44527 - DNA, 418 bp, Artificial
  Mutation in BnaC.FAD2.b introduced by TALE nuclease pair BnFAD2_T03
caggatccatgggtgcaggtgcaagaatgcaagtgtctcctccctccaaaaagtctgaaaccgacaacatcaagcgcgtaccctgcgagacaccaccattcactctgcgagacaccaccatgcaagtctctcctccctccagctcccccggaaccaacaccctcaaacgcgtcccctgcgagacaccaccacctcaagaaagcaatcccacctcactgcttcaaacgctccatcccacgctccttctcctcttcgacatcatcatctcctcctcggctcctccctctcccacctctccacagcctacttccctctcccttacctcgccttacccctctactgggcctgccaaggctgcgtcctaacgggcctctgggtcatcgcccacgaatgcggccaccacgccttcagcgactac

SEQ ID NO: 44528 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacacctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44529 - DNA, 350 bp, Artificial
  Mutation in BnaC.FAD2.b introduced by TALE nuclease pair BnFAD2_T03
caggacccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctcctgggcctgccaaggctgcgtcctaacgggcctctgggtcatcgcccacgaatgcggccaccacgccttcagcgactac

SEQ ID NO: 44530 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggggagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44531 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgatacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaacgggcctctgggtcatcgcccacgaatgcggccaccacgccttcagcgactac

SEQ ID NO: 44532 - DNA, 348 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctacctcaacacaacaatcccaccccactgctccaaacgctccacccctccctcctcctcctacctcctcttccacatcctcgtctcctcctccctctaccactgctccacagcctacttccctctcctcccccaccctctcccttacctcgcctgacccctctactgggcctgccaaggctgcgtcctaacgggcctctgggtcatagccaacgagtgcggccaccacgccttcagcgactac

SEQ ID NO: 44533 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctaccaaggctgcgtcctaacgggcctctgggtcatagcccacgagtgcggccaccacgccttcagcgactac

SEQ ID NO: 44534 - DNA, 326 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccaccattcactctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 44535 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 44536 - DNA, 349 bp, Artificial
  Mutation in BnaC.FAD2.b introduced by TALE nuclease pair BnFAD2_T03
caggatccatgggtgcaggtggaagaatgcaagtttctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44537 - DNA, 343 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 44538 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44539 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagaccacaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44540 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcttacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44541 - DNA, 356 bp, Artificial
  Mutation in BnaC.FAD2.b introduced by TALE nuclease pair BnFAD2_T03
caggatccatgggtgcaggtggaagaatgcaagtctctcctccccccagctcccccgaacccaaaaccctcaaacgcgtcccctgcgagacaccacccttcactctcggcggagacctcaagaaagcaatcccacctcactgcttcaaaccctccatccctcgctccttctcctacctcctctgcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44542 - DNA, 274 bp, Artificial
  Mutation in BnaC.FAD2.b introduced by TALE nuclease pair BnFAD2_T03
caggatccatgggtgcagatggaagaatgcaagtctctcctccctccagctcccccggaaccaacacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44543 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgtgtcctaacgggcctctgggtcatagcccacgagtgcggccaccacgccttcagcgactac

SEQ ID NO: 44544 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccacccttcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44545 - DNA, 469 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactctcggcttgaccccccagcaggtggtggccatcgccagcaataatggtggcaagcaggcgctggagacggtccagcggctgttgccggtgctgtgccaggcccacggcttgaccccggagcaggtggtggccatcgtgacctcaagaaagcaatccaccccccctccttcaaccgccccatcccccgctccttctcccccctcctctccgccaccctcgcctcctcctccccctcccccctccccccagcctccttccctctcccttccctcgcctgacccctctactgggcctgccaaggctgcgtcctaacgggcctctgggtcatagcccacgagtgcggccaccacgccttcagcgactac

SEQ ID NO: 44546 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcgtctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44547 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcacaagacctcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgagcctgccaaggctgcgtcctaacgggcctctgggtcatagcccacgagtgcggccaccacgccttcagcgactac

SEQ ID NO: 44548 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgacctcaagaaagcaatcccacctcactgcttcaaacgctccatcccacgctccttctcctcttcgacatcatcatctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 44549 - DNA, 423 bp, Artificial
  Mutation in BnaC.FAD2.b introduced by TALE nuclease pair BnFAD2_T03
caggatccatgggtgcaggtggaagaatgcaagtctctcctccctccagctcccccgaacccaaaaccctcacacgcgtcccctgcgagacaccacccttcactctctccagcggctgttgccggtgctgtgccaggcccacggcttgaccccccagcaggtggtggccatcgccagcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44550 - DNA, 333 bp, Artificial
  Mutation in BnaC.FAD2.b introduced by TALE nuclease pair BnFAD2_T03
caggatccatgggtgcaggtggaagaatgcaagtctctccgccctccagctcccccggaaccaacaccctcaaacgcgtcccctgcgagacaccaccattcactgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccatcagcgactac

SEQ ID NO: 44551 - DNA, 331 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgacta

SEQ ID NO: 44552 - DNA, 340 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44553 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgtagagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 44554 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaaactcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 44555 - DNA, 321 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccatgcgagacacacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44556 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctccacggctcctccctctaccacctctccacagcctacttccctctcccttacctcgcctgacccctctactgggcctgccaaggttgcgtcctaacgggcctctgggtcatagcccacgagtgcggccaccacgccttcagcgactac

SEQ ID NO: 44557 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccatcagcgactac

SEQ ID NO: 44558 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44559 - DNA, 381 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggagagcgttcaccgacaaacaacagataaaacgaaaggcccagtcacctcaagaaaccaatcccacctcactgcttcaaacgctccatcccacgctccttctcctcttcgacatcatcatctcctccacggctcctccctctcccacctctccccagcccccttccctctcccttacctcgcctgacccctctactgggcctgccaaggctgcgtcctaacgggcctctgggtcatagcccacgagtgcggccaccacgccttcagcgactac

SEQ ID NO: 44560 - DNA, 347 bp, Artificial
  Mutation in BnaC.FAD2.b introduced by TALE nuclease pair BnFAD2_T03
caggatccatgggtgcaggtgcaagaatgcaagtctctcctccctccagctcccccggaaccaacacccacaaacgcgtcccctgcgagacaccaccattcactacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcccctggcccctctactgggcctgccaaggctgcgtcctaacgggcctctgggtcattgcccacgagtgcggcctccacgcctgcatcgactac

SEQ ID NO: 44561 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaccgcgtcccctgcgagacaccacccttccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 44562 - DNA, 357 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggtttcccgactggaaagcagagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctatcgggcctctgggtcatagcccacgagtgcggccaccacgccttcagcgactac

SEQ ID NO: 44563 - DNA, 246 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgctagacaccacccttaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44564 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgtgcctgccaaggctgcgtcctaacgggcctctgggtcatagcccacgagtgcggccaccacgccttcagcgactac

SEQ ID NO: 44565 - DNA, 346 bp, Artificial
  Mutation in BnaC.FAD2.b introduced by TALE nuclease pair BnFAD2_T03
caggatccatgagtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44566 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccacctcactgcttcaaacgctccatcccacgctccttctcctcttcgacttcatcatctcctcctcggctcctccctctaccacctctccacagcctacttccctctcccttacctcgcctgacccctctactgggcctgccaagcctgcgtcctaacgggcctctgggtcatagcccacgagtgcggccaccacgccttcagcgactac

SEQ ID NO: 44567 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccgaggctgcgtcctaacgggcctctgggtcatcgcccacgaatgcggccaccacgccttcagcgactac

SEQ ID NO: 44568 - DNA, 416 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcttaggctccgcccccctgacgagcatcacaaaaatcgacgctcatccagcgcctgttgccggtgctgtgccaggcccacggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44569 - DNA, 344 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcagactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44570 - DNA, 364 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgaacgctctcctgagtaggacaaatccgctccctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44571 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 44572 - DNA, 404 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctctgacttgagcgtcgatttttgtgatgctcgtcagggggggccatcgccagcaatggcggcggcaggccggcgctggaacctcaagaaagcaatcccacctcactgcttcaaacgctccatcccacgctccttctcctcttcgacatcatcatcccctcctcggctcctccctctcccccctctccacagcctacttccctctcccttacctcgcctgacccctctactgggcctgccaaggctgcttcctaacgggcctctgggtcatagcccacgagtgcggccaccacgccttcagcgactac

SEQ ID NO: 44573 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatccctcgctccttctcctacctcctcttcgacatcctcgtctcctcctccctctaccacctctccacagcctacttccctctcctcccccacccgctcccttacctcgcctggcccctctactgggcctgccaaggctgcgtcctaacgggcctctgggtcatcgcccacgaatgcggccaccacgccttcagcgactac

SEQ ID NO: 44574 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcttcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44575 - DNA, 473 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcaaagctcgccgcgttgtttcatcaagccttaagggcgcgatcgttcaaacatttggcaataaagcgatggccaccacctgctggggggtcaagccgtgggcctggcacagcaccggcaacagagacctcaagaaagcaatcccacctcactgctgcaaacgctccatccctcgctccttctcctacctcctcttcgacatcctcgtctcctcctccctctaccacctctccacagcctacttccctctcctcccccaccctcgcccttacctcgcctggcccctctactgggcctgccaaggctgcgtcctaacgggcctctgggtcatcgcccacgaatgcggccaccacgccttcagcgactac

SEQ ID NO: 44576 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactacttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44577 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaccgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcggggtcatagcccacgagtgcggccaccacgccttcagcgactac

SEQ ID NO: 44578 - DNA, 336 bp, Artificial
  Mutation in BnaC.FAD2.b introduced by TALE nuclease pair BnFAD2_T03
caggatccatgggtgcaggtggaagaatgcaagtctatcctccctccagctcccccggaaccgacaccatcaagcgcgtaccctgcgagacaccgcccttcactgtagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44579 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44580 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcacgaaagcaatccacccacactgcttaacccgccccatcccttgctacttctcctcttcgacatcatcatctcctcctcgactccgccctctaccacctctccccagcctccttccctctcccctacctcgcctgacccctctactgggcctgccaaggctgtgtcctaacgggcctctgggtcatcgcccacgaatgcggccaccacgccttcagcgactac

SEQ ID NO: 44581 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccgtcagcgactac

SEQ ID NO: 44582 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggatgcgtcctaacgggcctctgggtcatcgcccacgaatgcggccaacacgccttcagcgactac

SEQ ID NO: 44583 - DNA, 336 bp, Artificial
  Mutation in BnaC.FAD2.b introduced by TALE nuclease pair BnFAD2_T03
caggatccatgggtgcaggtggaagaatgcaagtctatccaccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagccactac

SEQ ID NO: 44584 - DNA, 320 bp, Artificial
  Mutation in BnaC.FAD2.b introduced by TALE nuclease pair BnFAD2_T03
caggatccatgggtgcaggtggaagaatgcaagtctatcctcccttcagctcccccggaaccaacacccacaaacgcgtcccctgcgagacaccaccattcactgcttcaaacgctccatcccacgctccttctcctcttcgacatcatcatctcctcctcgtctcctccctctaccacctctccacagcctacttccctctcctcccccaccctctcccttacctcgcctggcccctctactgggcctgccaaggctccgtcctaacgggcctctgggtcatcacccgccaatgcggcctccacgccttcagcgactac

SEQ ID NO: 44585 - DNA, 322 bp, Artificial
  Mutation in BnaC.FAD2.b introduced by TALE nuclease pair BnFAD2_T03
caggatccatgggtgcaggtggatgaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44586 - DNA, 356 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtaccctgcgagacaccgcccttcactttgctccaagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44587 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 44588 - DNA, 378 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgcctgcttgccaccgccattgctggcgatggccaccacctttgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44589 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggacccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgaatgcggccaccacgccttcagcgactac

SEQ ID NO: 44590 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacttagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 44591 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccagagacctcaagaaagcaatcccacctcactgcttcaaacgctccatcccacgctccttctcctcttcgtcatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44592 - DNA, 354 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactctcgggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44593 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44594 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctctgagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44595 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44596 - DNA, 351 bp, Artificial
  Mutation in BnaC.FAD2.b introduced by TALE nuclease pair BnFAD2_T03
caggatccatgggcgcaggtggaagaatgcaagtctctcctccctccagctcccccggaaccaacaccctcaaacgcgtcccctgcgagacaccaccattcactctcgacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44597 - DNA, 334 bp, Artificial
  Mutation in BnaC.FAD2.b introduced by TALE nuclease pair BnFAD2_T03
caggatccatgggtgcaggcggaagaatgcaagtctctcctccctccagctcccccggaaccaacaccctcaaacgcgtcccctgcgagacaccaccattcactcaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44598 - DNA, 418 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgcgagacaccaccatgcaagtctctcctccctccagctcccccggaaccaacaccctcaaacgcgtcccctgcgagacaccaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 44599 - DNA, 335 bp, Artificial
  Mutation in BnaC.FAD2.b introduced by TALE nuclease pair BnFAD2_T03
caggatccatgggtgcaggtcaaagaatgcaagtgtatcctccctccaagaagtctgaaaccgacaccatcaagcgcgtaccatgcgagacaccgcccttcactgtagaactcaagaaagcaatcccaccgcactgtttcaaacgctcgatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccacctcgccttcaacgactac

SEQ ID NO: 44600 - DNA, 349 bp, Artificial
  Mutation in BnaC.FAD2.b introduced by TALE nuclease pair BnFAD2_T03
caggatccatgggtgcaggaggaagaatgcaagtgtatcctccctccaaaaagtctgaaaccgacaacatcaagcgcgtcccctgcgagacaccacccttcactaagacctcaagaaagcaatcccacctcactgcttcaaacgctccatccctcgctccttctcctacctcctcttcgacatcctcgtctcctcctccctctaccacccctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44601 - DNA, 335 bp, Artificial
  Mutation in BnaC.FAD2.b introduced by TALE nuclease pair BnFAD2_T03
caggatccatgggtgcaggtggaagaatgtaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44602 - DNA, 333 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactctcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44603 - DNA, 337 bp, Artificial
  Mutation in BnaC.FAD2.b introduced by TALE nuclease pair BnFAD2_T03
caggatccatgggtgcaggcggaagaatgcaagtctctcctccctccagctcccccggaaccaacaccctcaaacgagtcccctgcgagacaccaccattcactctcgaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccatcagcgactac

SEQ ID NO: 44604 - DNA, 350 bp, Artificial
  Mutation in BnaC.FAD2.b introduced by TALE nuclease pair BnFAD2_T03
caggatccatgggtgcaggtggaagaatgcaagtctctcctccctccaggtcccccggaaccaacaccctcaaacgcgtcccctgcgagacaccacccttcactctagaactcaagaaagcaatcccccctcactgcttcaaacgctccatccctcgctccttctcctacctcctcttcgacatcctcgtcgcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44605 - DNA, 269 bp, Artificial
  Mutation in BnaC.FAD2.b introduced by TALE nuclease pair BnFAD2_T03
caggatccatgggtgcaggtggaagaatgcaagtgtctcctccctcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44606 - DNA, 350 bp, Artificial
  Mutation in BnaC.FAD2.b introduced by TALE nuclease pair BnFAD2_T03
caggatccatgggtgcaggaggaagaatgcaagtgactcctccctccaagaagtctgaaaccgacaccatcaagcgcgtaccctgcgagacaccacccttcactctcgacctcaagaaagcaatcccacctcactgcttcaaacgctccatccctcgctccttctcctacctcctcttcgacatcctcgtctcctcctccctctaccacctctccacagcctacttccctctcctcccccaccctcgcccttacctcgcctggcccctctactggtcctgccaaggctgcggcctaacgggcctctgggtcatcgcccacgaatgcggccaccacgccttcagcgactac

SEQ ID NO: 44607 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44608 - DNA, 350 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaagcgcgtaccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgctgccaccacgccttcagcgactac

SEQ ID NO: 44609 - DNA, 292 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44610 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccatcagcgactac

SEQ ID NO: 44611 - DNA, 368 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacagccgctggaccgtctccagcgcctgtcggagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44612 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtaatcgcccacgaatgcggccaccacgccttcagcgactac

SEQ ID NO: 44613 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagacctcaagaaagcaaccccacctcactgcttcacacgctccatcccaccctccctctcttctccgacatcatcaactcctcctcggctcctccctctaccacctctccacagcctacttccctctccctcacctcgcctgacccctctactgggcctgccaaggctgcgtcctaacgggcctctgggtcatcgcccacgaatgcggccaccacgccttcagcgactac

SEQ ID NO: 44614 - DNA, 279 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttcgacatcctcgtctcctcctccctctaccacctctccacagcctacttccctctcctcccccaccctctctcctacttcgcctggcctctctactgggcctgccagtgctgcgtcctaaccggcgtctgggtcatagcccacgagtgcggccaccacgccttcagcgactac

SEQ ID NO: 44615 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 44616 - DNA, 351 bp, Artificial
  Mutation in BnaC.FAD2.b introduced by TALE nuclease pair BnFAD2_T03
caggatccatgggttcaggtggaagaatgcaagtctatcctccctccagctcccccgaaaccaaaaccctcaaacgcgtcccctgcgagacaccacccttcactcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcggcctaacgggcctctgggtcatcgcccacgagtgcggccacctcgcctgcagcgactac

SEQ ID NO: 44617 - DNA, 343 bp, Artificial
  Mutation in BnaC.FAD2.b introduced by TALE nuclease pair BnFAD2_T03
caggatccatgggtgcaggtgaaagaatgcaagtctctcctccctccagctcccccggaaccaaaaccctcaaacgcgtcccctgcgagacaccatcggagacctcaagaaagcaattccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcggggtcatcgcccacgaatgcggcctccacgccttcagcgactac

SEQ ID NO: 44618 - DNA, 368 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacagccgctggaccgtctccagcgcctgtcggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44619 - DNA, 345 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactcttcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggccggccaagactgcgtcctaacgggcctctgggttatcgcccacgaatgcggccaccacgccttcagcgactac

SEQ ID NO: 44620 - DNA, 288 bp, Artificial
  Mutation in BnaC.FAD2.b introduced by TALE nuclease pair BnFAD2_T03
caggatccatgggtgcaggtggaagaatgcaagtctctcatccctccaggtagacctcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44621 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctctgggtcatagcccacgagtgcggccaccacgccttcagcgactac

SEQ ID NO: 44622 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacatgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44623 - DNA, 427 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaccacctgctggggggtcaagccgtgggcctggcacctgctccggggtcaagccgtgggccagccacgatggcggcaagcaggcgctggagagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44624 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 44625 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctccctctaccacctctccacagcctacttccctctcctccccccccctctcccttacctcgcctggcccctctactgggcctgccaaggctgcgtcctaacgggcctctgggtcatagcccacgagtgcggccaccacgccttcagcgactac

SEQ ID NO: 44626 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 44627 - DNA, 435 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccgtccagcggctgttgccggtgctgtgccaggcccacggcttgaccccggagcaggtggtggccatcgccagccacgatggcggcaagcaggcgctggagagagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 44628 - DNA, 353 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44629 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgcaaaggctgcgtcctaacgggcctctgggtcatagcccacgagtgcggccaccacgccttcagcgactac

SEQ ID NO: 44630 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaagatagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44631 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44632 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44633 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44634 - DNA, 347 bp, Artificial
  Mutation in BnaC.FAD2.b introduced by TALE nuclease pair BnFAD2_T03
caggatcctgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44635 - DNA, 279 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcaccgactac

SEQ ID NO: 44636 - DNA, 344 bp, Artificial
  Mutation in BnaC.FAD2.b introduced by TALE nuclease pair BnFAD2_T03
caggatccatgggtgcagggggaagaatgcaagtgtctactcactccaagaagtctgaaaccgacaccatcaagcgcgtaccctgcgagacaccgcccttcactctcggaaagcaatcccacctcactgcttcaaacgctccatcccacgctccttctcctcttcgacatcatcatctcctcctcggctcctccctctaccacctatccacagcctacttccctctcctcccccaccctctcccttacctcgcctagcccctctactgggcctgccaaggctgcgtcctaacgggcctcggggtcatcgcccacgagtgcgtcctccgcgccttcagcgactac

SEQ ID NO: 44637 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccatggcggacctcaagaaagcaatcccaccttactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 44638 - DNA, 295 bp, Artificial
  Mutation in BnaC.FAD2.b introduced by TALE nuclease pair BnFAD2_T03
caggatccattggtgcaggtggaagaatgcaagtctctcatccctccaggtagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44639 - DNA, 276 bp, Artificial
  Mutation in BnaC.FAD2.b introduced by TALE nuclease pair BnFAD2_T03
caggatccatgggtgcaggtggaagaatgcaagtctctcctctcggcgacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 44640 - DNA, 246 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44641 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 44642 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgtcaaggctgcgtcctaaccggcgtctgggtcatagcccacgagtgcggccaccacgccttcagcgactac

SEQ ID NO: 44643 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 44644 - DNA, 368 bp, Artificial
  Mutation in BnaC.FAD2.b introduced by TALE nuclease pair BnFAD2_T03
cagggatccatgggtgcaggtggaagaatgcaagtctctcctccctccagctcccccggaaccaacaccctcaaacgcgtcccctgcgagacaccaccattcactctcggcatcaaactaagcagaaggccatccgtcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44645 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44646 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgagacctcaagaaagcaatcccacctcactgcttcaaacgctccatccctcgctccttctcctacctcctcttcgacatcctcgtctccccctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44647 - DNA, 335 bp, Artificial
  Mutation in BnaC.FAD2.b introduced by TALE nuclease pair BnFAD2_T03
caggatccatgggtgcaggtggaagaatgcaagtctctcctccctccagctccaccggaaccaacaccctcaaacgcgtcccctgcgagacaccaccattcactcagacctcaagaaagcaatcccacctcactgcttcaaacgctccatcccacgctccttctcctcttcgacataatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44648 - DNA, 342 bp, Artificial
  Mutation in BnaC.FAD2.b introduced by TALE nuclease pair BnFAD2_T03
caggatccatgggtgcaggtcgaagaatgcaagtctctcctccctccagctcccccgaaaccaaaaccctcaaacgcgtcccctgcgagacaccaccctgacctcaagaaagcaatcccacctcactgcttcaaacgctccatccctcgctccttttcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44649 - DNA, 413 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggctgttgccggtgctgtgccaggcccacggcttgaccccggagcaggtggtggccatcggagacctcaagaaagcaatcccacctcactgcttcaaacgctccatcccacgctccttctcctcttcgacatcatcatctcctcctcggctcctcccgctaccacctctccacagcctacttccctctcctcccccaccctctcccttacctcgcctggcccctctactgggccggccaaggctgcgtcctaacgggcctctgggtcatcgcccacgaaggctgccaccacgccttcatcgactac

SEQ ID NO: 44650 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttcctcaagaaagcaatcccacctcactgcttcaaacgctccatcccaccctccttctcctcttcgacatcatcatctcctcctcggctccgccctctaccacttctccacagcctccttccctctcccttacctcgcctggcccctctactgggcctgccaaggctgcgtcctaacgggcctctgggtcatagcccacgagtgcggccaccacgccttcagcgactac

SEQ ID NO: 44651 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 44652 - DNA, 382 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactactgacagaaccgcaacgttgaaggagccactcagccgcgggtttctgagacctcaagaaagcaatcccacctcactgcttcaaacgctccatccctcgctccttctcctcttcgacatcatcatctcctcctcggctcctccctctcccacctctccacagcctacttccctctcccttacctcgcctgacccctctactgggcctgccaaggctgtgtcctaacgggcctctgggtcatagcccacgagtgcggccaccacgccttcagcgactac

SEQ ID NO: 44653 - DNA, 440 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctccccccagcaggtggtggccatcgccagcaatggcggtggcaagcaggcgctggagacggcccagcggctgttgccggtgctgtgccaggagacctcaagaaagcaatcccacctcactgcttcaaacgctccatccctcgctccttctcctacctcctctccgacatcctcggctcctcctccctctaccacctctccacagcctacttccctctccccccccaccctctcccttacctcgcctggcccctctactgggcctgccaaggctgcgtcctaacgggcctctgggtcatcgcccacgaatgcggccaccacgccttcagcgactac

SEQ ID NO: 44654 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44655 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44656 - DNA, 331 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 44657 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctctcaagaaagcaatcccacctcactgcttcaaacgctccacccctcactccttctcctacctcctcttcgacatcctcgtctcctcctccctctaccacccctccacagcccacttccctcccctccccccccctctcccttacctcgcctggcccctctactgggcctgccaaggctgcgtcctaacgggcctctgggtcatagcccacgagtgcggccaccacgccttcagcgactac

SEQ ID NO: 44658 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctagcaggcgctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagctactac

SEQ ID NO: 44659 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctctgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgtggccaccacgccttcagcgactac

SEQ ID NO: 44660 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44661 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44662 - DNA, 335 bp, Artificial
  Mutation in BnaC.FAD2.b introduced by TALE nuclease pair BnFAD2_T03
caggatccatgggtgcaggtggaagaatgcaagtcagtcctacctcaagctcccccggaaccaacaccctcaaacgcgtcccctgcgagacaccaccattcacttaaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtccgaacgggcctctgggtcatagcccacgagtgcggcctccacgccatcagcgactac

SEQ ID NO: 44663 - DNA, 325 bp, Artificial
  Mutation in BnaC.FAD2.b introduced by TALE nuclease pair BnFAD2_T03
caggatccatgggtgcaggtggaagaatgcaagtgtctcctccctccaagaagtctaaaaccgacaccatcaagcgcgtatagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44664 - DNA, 349 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactcagacctcaagaaagcaatcccacctcactgcttcaaacgctccatccatcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggcctccacgccttcagcgactac

SEQ ID NO: 44665 - DNA, 346 bp, Artificial
  Mutation in BnaC.FAD2.b introduced by TALE nuclease pair BnFAD2_T03
caggatccatgggtgcaggtgcaagaatgcaagtctatcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44666 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaaggcggccaccacgccttcagcgactac

SEQ ID NO: 44667 - DNA, 335 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgtgtcatcgcccacgaatgcggccaccacgccttcatcgactac

SEQ ID NO: 44668 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctccattacctcgcctgacccctctactgggcctgccaaggctgcgtcctaacgggcctctgggtcatagcccacgagtgcggccaccacgccttcagcgactac

SEQ ID NO: 44669 - DNA, 354 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44670 - DNA, 334 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaagcgcgtaccctgcgagacaccacccttcactcgaacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgcgcctgcctgggctgcgtcctaaccggcgtctgggtcacagcccacgagtgcggccaccacgccttcagcgactac

SEQ ID NO: 44671 - DNA, 277 bp, Artificial
  Mutation in BnaC.FAD2.b introduced by TALE nuclease pair BnFAD2_T03
caggatccatgggtgcagggtggaagaatgcaagtctctcctctcggagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 44672 - DNA, 431 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggagagagcgagattctcggcgcaatgcactgacgggtgccccgctcaacttgaccccccagcaggcaacagataaaacgaaaggcccagtcggagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 44673 - DNA, 461 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctctccagcgcctgcttgccgccatcgtggctggcgatggccaccacctgctccggggtcaagccgtgggcctggcacagcaccggcaagcaggcgctggagacggtccagcggctgttgccgccagagacctcaagaaagcaatcccacctcactgcttcaaacgctccatcccacgctccttctcctctccgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44674 - DNA, 335 bp, Artificial
  Mutation in BnaC.FAD2.b introduced by TALE nuclease pair BnFAD2_T03
caggatccatgggtgcaggtggaagaatgcaagtatatcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgctgccaccacgccttcagcgactac

SEQ ID NO: 44675 - DNA, 363 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttaagaaagcaatcccacctcactgcttcaaacgctccatccctcgctccttctcctacctcctcttcgacatcctcgtctcctcctccctctaccacctctccacagcctacttccctctcctcccccccccgcccccttccccccccccccccaccctctcccttacctcgcctggcccctctactgggcctgccaaggctgcgtcctaacgggcctctgggtcatcgcccacgaatgcggccaccacgccttcagcgactac

SEQ ID NO: 44676 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagaccccaccattcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcagccaccacgccttcagcgactac

SEQ ID NO: 44677 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggccggccaaggctgcgtcctaacgggcctctgggtcatcgcccacgaatgcggccaccacgccttcagcgactac

SEQ ID NO: 44678 - DNA, 357 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggcctttttacggttcctctccctcccacctcactgcttcaaacgctccatccctcgctccttctcctacctcctcttcgacatcctcgtctcctcctccctccaccccctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44679 - DNA, 279 bp, Artificial
  Mutation in BnaC.FAD2.b introduced by TALE nuclease pair BnFAD2_T03
caggatccatgggtgcaggtggaagaatgcaagtctcgacctcaagaaagcaatcccacctcactgcttcaaacgctccatccctcgctccttctcctacctcctcttcgacatcctcgtctcctcctccctctaccacctctccacagcctacttccctctcctccccaccctctcccttacctcgcctggcccctctactgggcctgccaaggctgcgtcctaacgggcctctgggtcatcgcccacgaatgcggccaccacgcctccagcgactac

SEQ ID NO: 44680 - DNA, 342 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44681 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaaacgcgtcccctgttatcgagacctcaagaaagcaatcccacctcactgcttcaaacgctccatcccacgccccttctcctcttctacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44682 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctccttccctctcccttacctcgcctggcccctctactgggcctgccaaggctgcgtcctaacgggcctctgggtcatagcccacgagtgcggccaccacgccttcagcgactac

SEQ ID NO: 44683 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttgcctcgcctggcccctctactgggcctgccaaggctgcgcccgaacgggcctctgggtcatcgcccacgaatgcggccaccacgccttcagcgactac

SEQ ID NO: 44684 - DNA, 349 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaattcggccaccacgccttcagcgactac

SEQ ID NO: 44685 - DNA, 319 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccatcccaccgcactgtttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44686 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44687 - DNA, 368 bp, Artificial
  Mutation in BnaC.FAD2.b introduced by TALE nuclease pair BnFAD2_T03
caggatccatggtgcaggtggaagaatgcaagtctctcctccctccagctcccccggaaccaacaccctcaaacgcgtcccctgcgaggcccacggcttgaccccggagcaggtggtggccatcgcctggcacgatggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44688 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcccgacccctctactgggcctgccaaggctgcgtcctaacgggcctctgggtcatcgcccacgaatgcggccaccacgccttcagcgactac

SEQ ID NO: 44689 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttaaagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44690 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtgaactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44691 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcatgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgtgcctctgggtcatagcccacgatggcggccaccacgccttcagcgactac

SEQ ID NO: 44692 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgaatgcggccaccacgccttcagcgactac

SEQ ID NO: 44693 - DNA, 353 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44694 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagggcggccaccacgccttcagcgactac

SEQ ID NO: 44695 - DNA, 406 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccagcgcctgcttgccaccattattgctggcgatggccaccacctgctggggggtcaagttgagcggggcacccgtcagtgcattgcgccagagacctcaagaaagcaatcccacctcactgcttcaaacgctccatccctcgctccttctcctacctcctcttcgacatcctcgtctcctcccccctctaccacctctccacagccgacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44696 - DNA, 351 bp, Artificial
  Mutation in BnaC.FAD2.b introduced by TALE nuclease pair BnFAD2_T03
caggatccatgggtgcaggtgggagaatgcaagtctctcctccctccagctcccccggaaccaacaccctcaaacgcgtcccctgcgagacaccaccattcactctcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44697 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcgagacctcaagaaagcaatcccacctcactgcttcaaacgctccatcccacgctccttctcctcttcgacatcatcatctcctcctcgtctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44698 - DNA, 335 bp, Artificial
  Mutation in BnaC.FAD2.b introduced by TALE nuclease pair BnFAD2_T03
caggatccatgggtgcagggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44699 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgtgaactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgggccaccacgccttcagcgactac

SEQ ID NO: 44700 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 44701 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccatcaaacgcgtcccctgcgagacaccacccttcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44702 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccttagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 44703 - DNA, 435 bp, Artificial
  Mutation in BnaC.FAD2.b introduced by TALE nuclease pair BnFAD2_T03
caggatccatgggtgcaggtggaagaatgcaagtctctcctcactccagctcccccggaaccaacaccctcaaacgcgtcccctgcgagacaccaccattcactctcggtgttgtgccaggcccacggcttgaccccggagcaggtggtggccatcgccagccacgatggcggcaacagccgctggacccagacctcaagaaagcaatcccacctcactgcttcaaacgctccatcccacgctccttctcctcttcgacatcatcatctcctccgcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagggactac

SEQ ID NO: 44704 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaaggctgcgtcctaacgggcctctgggtcatagcccacgagtgcggccaccacgccttcagcgactac

SEQ ID NO: 44705 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacgtcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44706 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattctcaagaaagcaatcccacctcactgcttcaaacgctccatcccacgctccttctcctcttcgacatcatcatctcctcctcggctcctccctctaccacctctccacagccttcttccctctcccttacctcgcctgacccctctactgggcctgccaaggctgcgtcctaacgggcctctgggtcatagcccacgagtgcggccaccacgccttcagcgactac

SEQ ID NO: 44707 - DNA, 435 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggtccagcggctgttgccggtgctgtgccaggcccacggcttgaccccccagcaggtggtggccatcgccagcaatggcggtggcaagcaggcgctggagagacctcaagaaagcaatcccacctcactgcttcaaacgctccagccctcgctccttctcctcttcgacatcatcatctcctcctcggctcctccctctaccacctctccacagcctacttccctctcccttacctcgcctgacccctctactgggcctgccaagggtgcgtcctgaccggcgtctgggtcatagcccacgagtgcggcgaccgcgccttcaacgactac

SEQ ID NO: 44708 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacctcaagaaagcaatcccacctcactgcttcacacgctccatccctcgctccttctcctccctccccttcgacatcctcacctcctcctccctctaccacctctccacagcctacttccctctccccccccaccctctcccttacctcgcctggcccctctactgggcctgccaaggctgcgtcctaacgggcctctgggtcatcgcccacgaatgcggccaccacgccttcagcgactac

SEQ ID NO: 44709 - DNA, 435 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactatcagagattttgagacacgggccagagctgccaggaaacagctatgaccatgtaatacgactcactataggggatgggatccgatgaagacaatcgacagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44710 - DNA, 291 bp, Artificial
  Mutation in BnaC.FAD2.b introduced by TALE nuclease pair BnFAD2_T03
caggatccatgggagcaggtggaagaatgcaagtatctcccccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44711 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactgc

SEQ ID NO: 44712 - DNA, 334 bp, Artificial
  Mutation in BnaC.FAD2.b introduced by TALE nuclease pair BnFAD2_T03
caggatccatgggtgcaggtggaagaatgcaagtcaatcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44713 - DNA, 320 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 44714 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcacttaacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44715 - DNA, 299 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctccttctcctacctcctcttcgacatcatcatctcctcctcggctactccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44716 - DNA, 431 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggcaggtggtgaccatcgccagcaatggcggtggcaagcaggcgctggagacggtccagcggctgttgccggtgctgtgccaggcccacggctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44717 - DNA, 343 bp, Artificial
  Mutation in BnaC.FAD2.b introduced by TALE nuclease pair BnFAD2_T03
caggatccatgggtgcaggcggaagaatgcaagtctctcctcactccagctcccccgaacccaaaaccctcaaacgcgtcccctgcgagacaccatcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctggcccctctactgggcctgccaaggctgcgtcctaaggggcctctggggcatcgcccacgaatgcggcctccacgccagcagcgactac

SEQ ID NO: 44718 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 44719 - DNA, 349 bp, Artificial
  Mutation in BnaC.FAD2.b introduced by TALE nuclease pair BnFAD2_T03
caggatccatgggtgcaggtggaagaatgcaagtctctcctcactccagctcccccggaaccaacaccctcaaacgcgtcccctgcgagacaccaccattcactcggacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 44720 - DNA, 394 bp, Artificial
  Mutation in BnaC.FAD2.b introduced by TALE nuclease pair BnFAD2_T03
caggatccatgggtgcaggtggaagaatgcaagtctctcctccctccagctcccacggaaccaacaccctcaaacgcgtcccctgcgagacaccaccattcactctcggtgccaggcccacggcttgaccccccagcaggtggtggccagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44721 - DNA, 432 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactccagcggctgttgccggtgctgtgccaggcccacggcttgaccccggagcaggtggtggccatcgccagccacgatggcggtggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44722 - DNA, 336 bp, Artificial
  Mutation in BnaC.FAD2.b introduced by TALE nuclease pair BnFAD2_T03
caggatccatgggtgcaggtggaagaatgcaagtctctcctcactccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44723 - DNA, 338 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44724 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccatagacctcaagaaagcactcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44725 - DNA, 347 bp, Artificial
  Mutation in BnaC.FAD2.b introduced by TALE nuclease pair BnFAD2_T03
caggatccatgggtgcaggtggaagaatgcaagtctctcctccctccagatcccccgaaaccaaaaccctcaaacgcgtcccctgcgagacaccacccttcactcgcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44726 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44727 - DNA, 418 bp, Artificial
  Mutation in BnaC.FAD2.b introduced by TALE nuclease pair BnFAD2_T03
caggatccatgggtgcaggtggaagaatgcaagtctctcctccctcaagctcccccggaaccaacaccctcaaacgcgtcccctgcgagacaccaccattcactctagatcggcgatatcgatgctgtccatgtgctgtctctcgaacttggcagcggcagtctccttatcggagacctcaagaaagcaatcccacctcactgcttcaaacgctccatcccacgctccttctcctcttcgacatcatcatctcctcctcggctcctccctctaccacctctccacagcctacttccctcgcctcccccaccctctcccttacctcgcctggcccctctactgggcctgccaaggctgcgtcctaacgggcctctgggtcatcgcccacgaatgcggccaccacgccttcagcgactac

SEQ ID NO: 44728 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44729 - DNA, 348 bp, Artificial
  Mutation in BnaC.FAD2.b introduced by TALE nuclease pair BnFAD2_T03
cagtatccatgggtgcaggtggaagaatgcaagtgtctcctccctccaagaagtctgaaaccgacaccatcaagcgcgtaccctgcgagacaccgcccttcactgtaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44730 - DNA, 322 bp, Artificial
  Mutation in BnaC.FAD2.b introduced by TALE nuclease pair BnFAD2_T03
caggatccatgggtgcaggcagaagaatgcaagtctctcctccctccagctcccccgaaaccaaaaccctcaaacgcgtcccctgcgagcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccgcgccttcagcgactac

SEQ ID NO: 44731 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44732 - DNA, 386 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggcaccggcaacagccgctggaccgtctccagcgcctgcttgccaccagagacctcaagaaagcaatcccacctcactgcttcaaacgctccatcccacgctccttctcctcttcgacatcatcatatcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 44733 - DNA, 357 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcctttttacggttcctctccctcccacctcactgcttcaaacgctccatccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatagcccacgagtgcggccaccacgccttcagcgactac

SEQ ID NO: 44734 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 44735 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44736 - DNA, 463 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgaccccggagcaggtggtggccatcgccagccacgatggtggcaagcaggcgctggagacggtccagcggctgttgccggtgctcagaccccgtagaaaagatcaaaggatctagaccccaagaaagcaatcccacctcactgctccaaacgctccatcccacgctccttctcctaccccctctccgacatcctcgtctcctcctccctctaccacctctccacagcctacttccctctcctcccccaccctctcccttacctcgcctggcccctctactgggcctgccaaggctgcgtccgaacgggcctctgggtcatcgcccacgaaggcggccaccacgccttcagcgactac

SEQ ID NO: 44737 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaactcctccctcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagggcggccaccacgccttcagcgactac

SEQ ID NO: 44738 - DNA, 333 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 44739 - DNA, 351 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44740 - DNA, 394 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaccgcgtcccctgcgagacaccaccattcactcttggccaccacctgctccggagtcaagctggaggggtacaccttccaccactcgttgggagacctcaagaaagcaatcccacctcactgcttcaaacgctccatcccacgctccttctcctcttcgccatcatcatctcctcctcggctcctccctctaccacctctccacagcctccttccctctcccttacctcgcctcacccctctactgggcctgccaaggctgcgtcctaacgggcctctgggtcatcgcccacgaatgcggccaccacgccttcagcgactac

SEQ ID NO: 44741 - DNA, 350 bp, Artificial
  Mutation in BnaC.FAD2.b introduced by TALE nuclease pair BnFAD2_T03
caggatccatgggtgcaggtggaagaatgcaagtctctcctcactccagctcccccgaaaccaaaaccctcaaacgcgtcccctgcgagacaccacccttcacttagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 44742 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 44743 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctctgggtcatcgcccacgaatgcggccaccacgccttcagcgactac

SEQ ID NO: 44744 - DNA, 396 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggttcagcctggtcagctgggccttgtagttgcccttgaagtggccggacacgaacaggagaactcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 44745 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44746 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 44747 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggcggcgtcctaacgggcctctgggtcatcgcccacgaatgcggccaccacgccttcagcgactac

SEQ ID NO: 44748 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccatctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44749 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgacac

SEQ ID NO: 44750 - DNA, 340 bp, Artificial
  Mutation in BnaC.FAD2.b introduced by TALE nuclease pair BnFAD2_T03
caggatccatgggtgcaggtggaagaatgcaagtctctccaccctccagctcccccggaaccaacaccctcaaacgcgtcccctgcgagacaccacccttcactcacctcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44751 - DNA, 346 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactctctcaagaaagcaatcccacctcactgcttcaaacgctccatccctcgctccttctcctacctcctcttcgacatcctcgtctcctcctccctctaccacctctccacagcctacttccctcgcctcccccaccctctcccttacctcgcctggcctctctactgggcctgccatggctgcgtccgaaccggcgtcggggtcatagcccacgagtgcggccaccacgccttcagcgactac

SEQ ID NO: 44752 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 44753 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctctctgcttcaaacgctccatcccaccctccttctcctcttcgacttcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44754 - DNA, 326 bp, Artificial
  Mutation in BnaC.FAD2.b introduced by TALE nuclease pair BnFAD2_T03
caggatccatgggtgcaggcggaagaatgcaagtgtctactccctccaaaaagtctgaaaccgacaacatcacgcgcgtcccctgcgagacaccaccattctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcttcctaacgggcctctgggtcatcgcccacgaatgctgccaccacgccttcagcgactac

SEQ ID NO: 44755 - DNA, 280 bp, Artificial
  Mutation in BnaC.FAD2.b introduced by TALE nuclease pair BnFAD2_T03
caggatccatgggtgcaggtagaagaatgcaagtctctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctatcgtgcctctgggtcatcgcccacgaatgcggccaccacgccttcagcctac

SEQ ID NO: 44756 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacctcaagaaagcaatcccacctccctgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 44757 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgcgacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggccgctgggtcatagcccacgagggcggccaccacgccttcagcgactac

SEQ ID NO: 44758 - DNA, 409 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgactacggcgtgatcgtggacaccacgagcatcacaaaaatcgacgctcaagtcagaggtggcgaaacccggagacctcaagaaagcaatcccacctcactgcttcaaacgctccatcccacgctccttctcctcttcgacatcatcatctcctcctcggctcctccctctcccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 44759 - DNA, 301 bp, Artificial
  Mutation in BnaC.FAD2.b introduced by TALE nuclease pair BnFAD2_T03
caggatccatgggtgcaggtggaagaatgcaagtctctcctccctcccgtccccccggaaacaacaccctcagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 44760 - DNA, 417 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgttgtccggccacttcaagggcaactacaaggcccagctgaccaggctgaaccacatcaccaactgcggagaactcaagaaagcaatcccaccgcactgcttcaaacgctccatccctcgctccttctcctacctcctcttcgacatcctcgtctcctcctccctctaccccctctccacagcctacttccctctcctcccccaccctctccattacctcgcctggcccctctactgggcctgccaaggctgcgtcctaacgggcctctgggtcatcgcccacgaatgcggccaccacgccttcagcgactac

SEQ ID NO: 44761 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 44762 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44763 - DNA, 385 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggggtcaagccgtgggcctggcacagcaccggcaacagccgctggaccgagacctcaagaaagcaatcccaccgcactgtttcaaacgctcgatccctcgctccttctcctacctcctcttcgacatcctcgtctcctcctccccctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44764 - DNA, 378 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcggcgggtgtgggggttacccgcaaagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44765 - DNA, 330 bp, Artificial
  Mutation in BnaC.FAD2.b introduced by TALE nuclease pair BnFAD2_T03
caggatccatgggtgcaggtggaagaatgcaagtctctcctcactccagctcccccggaaccaacaccctcaaacgcgtcccctgcgagacaccaccattcactctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtccgaacgggcctctgggtcatcgcccgcgaatgcggccacaacgcctgaagcgactac

SEQ ID NO: 44766 - DNA, 333 bp, Artificial
  Mutation in BnaC.FAD2.b introduced by TALE nuclease pair BnFAD2_T03
caggatcaatgggtgcaggtggaagaatgcaagtctctcctccctccagctcccccggaaccaacaccctcaaacgcgtcccctgcgagacaccaccattcactctactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44767 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaacctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44768 - DNA, 336 bp, Artificial
  Mutation in BnaC.FAD2.b introduced by TALE nuclease pair BnFAD2_T03
caggatccatgggtgcaggcggaagaatgcaagtctctcctccctccagctcccccgaaaccaaaaccctcaaacgcgtcccctgcgagacaccacccttcactcggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccagggctgcgtcctaaccggcgtctgggtcatagcccacgagtgcgtccaccacgccttcaacgactac

SEQ ID NO: 44769 - DNA, 427 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacgatggccaccacctgctccggggtcaagccgtcgatttttgtgatgctcgtcaggggggcggagcctatggaaaaacgccagcaacgcggagacctcaagaaagcaatcccacctcactgcttcaaacgctccatcccacgctccttctcctctccgacatcatcagcgcctcctcggctcctccctctgccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 44770 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatagcccacgagtgcggccaccacgccttcagcgactac

SEQ ID NO: 44771 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 44772 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacgccacccttcactcggagacctcaagaaagcaatcccacctcactgcttcaaacgctccatccctcgctccttctcctacctcctcttcgacatcctcgtctcctcctccctctaccacctctccacagcctacttccctctcctcccccaccctctccattacctcgcctggcccctctactgggcctgccaaggctgcgtcctaacgggcctctgggtcatcgcccacgaatgcggccaccacgccttcagcgactac

SEQ ID NO: 44773 - DNA, 315 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44774 - DNA, 349 bp, Artificial
  Mutation in BnaC.FAD2.b introduced by TALE nuclease pair BnFAD2_T03
caggatccatgggtgcaggtggaagaatgcaagtctatactccctccagctcccccgaaaccaaaaccatcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctcgcccttacctcgcctggcccctctactgggccttccaaggctgcgtcctaacgggcctctgtgtcatcgcccacgaatgcggcctccacgcctgcatcgactac

SEQ ID NO: 44775 - DNA, 280 bp, Artificial
  Mutation in BnaC.FAD2.b introduced by TALE nuclease pair BnFAD2_T03
caggatccatgggtgcaggtggaagaatgcaagtctcgacctctagaaaacaatcccacctcactgcttcaaacgctccatccctcgctccttctcctacctcctcttcgacatcctcgtctcctcctccctctaccacctctccacagcctacttccctctcctcccccaccctctcccttacttcgcctgtctcctctactgggcctgccaaggccgcgtcctaactggcctctgggtcatcacccacgagtgcggccaccacgccttcagcgactac

SEQ ID NO: 44776 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgctgccaccacgccttcagcgactac

SEQ ID NO: 44777 - DNA, 336 bp, Artificial
  Mutation in BnaC.FAD2.b introduced by TALE nuclease pair BnFAD2_T03
caggatccatgggtgcaggtggaagaatgcaagtctctcctcactccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44778 - DNA, 334 bp, Artificial
  Mutation in BnaC.FAD2.b introduced by TALE nuclease pair BnFAD2_T03
caggatccatgggtgcaggtggaagaatgcaagtctctcctcactccagctcccccggaaccaacaccctcaaacgcgtcccctgcgagacaccaccatttcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44779 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcatcgactac

SEQ ID NO: 44780 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccagcacgccttcagcgactac

SEQ ID NO: 44781 - DNA, 334 bp, Artificial
  Mutation in BnaC.FAD2.b introduced by TALE nuclease pair BnFAD2_T03
caggatccatgggtgcaggtggaagaatgcaagtctctccaccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgtgtcatcgcccacgaatgcggccaccacgccttcagcgactac

SEQ ID NO: 44782 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44783 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 44784 - DNA, 350 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 44785 - DNA, 327 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44786 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccacggctgcgtcctaacgggcctctgggtcatagcccacgagtgcggccaccacgccttcagcgactac

SEQ ID NO: 44787 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttgcctcgcctgacccctctactgggcctgccaaggctgcgtcctaacgggcctctgggtcatagcccacgagtgcggccaccacgccttcagcgactac

SEQ ID NO: 44788 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatcccacgctccttctcctcttctacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44789 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 44790 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacacctcaagaaagcaatcccaccgcactgtttcaaacgctccatccctcgctccttctcctacctcctcttcgacatcctcgtctcctcctccctctactacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44791 - DNA, 442 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacgatggccaccacctgctccggggtcaagccgtcgatttttgtgatgctcgtcaggggggcggagcctatggaaaaacgccagcaacgcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44792 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagatctcaagaaagcaatcccacctcactgcttcaaacgctccatcccacgctccttctcctcttcgacatcatcatctcctcctcgcctcctccctctaccacctctccacagccttcttccctctctcctactgcgcctggcctctctactgggcctgccaagggtgcgtcctaaccggcgtctggggcatcgcccacgaatgcggcctccacgccatcagcgactac

SEQ ID NO: 44793 - DNA, 350 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44794 - DNA, 348 bp, Artificial
  Mutation in BnaC.FAD2.b introduced by TALE nuclease pair BnFAD2_T03
caggatccatgggtgcaggtcgaagaatgtaagtctctcctccctccagctcccccgaaaccaaaacactcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactggtcctgccaaggctgcgtcctaactggcctctgggtcatcgcccacgaaggctgccaccgcgccttcagcgactac

SEQ ID NO: 44795 - DNA, 356 bp, Artificial
  Mutation in BnaC.FAD2.b introduced by TALE nuclease pair BnFAD2_T03
caggatccatgggtgcaggcggaagaatgcaagtgtctcctccctccaagaagtctgaaaccgacaccatcaagcgcgtaccctgcgagacaccgcccttcactgtcgacggagaactcaagaaagcaatcccaccgcactgtttcaaacgctcgatccctcgctccttctcctacctcctcttcgacatcctcgtctcctcctccctctaccacctctccacagcctacttccctctccttccccaccctctcccttacctcgcctggcccctctactgggcctgccaaggctgcgtcctaacgggcctctgggtcatcgcccacgaatgcggccaccacgccttcagcgactac

SEQ ID NO: 44796 - DNA, 378 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactctgcgatggcggcaagcaggcgctggagaagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44797 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 44798 - DNA, 344 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccaccattcactctcgggtcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcgcacgagtgcggccaccacgccttcagcgactac

SEQ ID NO: 44799 - DNA, 278 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacatcctcgtctcctcctccctctaccacctctccacagcctacttccctctcctcccccaccctctcccttacctcgcctggcccctctactgggcctgtcaaggctgcgtcctaacgggcctctgggtcatcgcccacgaatgcggccaccacgccttcagcgactac

SEQ ID NO: 44800 - DNA, 324 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacctcaagaaagcaatcccacctcactgcttcaaacgctccatccctcgctccttctcctacctcctcttcgacatcatcatctcctcctcgactcctccctctaccacctctccacagcctacttccctctcccttacctcccctgacccctctactgggcctgccaaggctgctgcctgacgggcctcggggtcatatcccacgagtgcggccaccacgccttcagcgactac

SEQ ID NO: 44801 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgtcaaggctgcgtcctaacgggcctctgggtcatagcccacgagtgcggccaccacgccttcagcgactac

SEQ ID NO: 44802 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 44803 - DNA, 329 bp, Artificial
  Mutation in BnaC.FAD2.b introduced by TALE nuclease pair BnFAD2_T03
caggatccatgggtgcaggtggaagaatgcaagtctatcctccctcaagctcccccggaaccaacaccctcaaacgcgtcccctgcgagacaccaccatgctccttaagaaagcaatcccacctcactgcttcaaacgctccatcccacgctccttctcctcttcgacgtcatcatctcctcctcggcccctccctctaccacctctccacagcctacttccctctcccttacctcgcctgacccctctactgggccggccaaggctgcttcctaacgggcctcggggtcatagcccgcgagtgctgccaccacgccttcagcgactac

SEQ ID NO: 44804 - DNA, 411 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccaccattcactcagccgaacgaccgagcgcagcgagtcagtgagcgaggaagcggaagagcgcccaatacgcggagacctcaagaacgcaatcccacctcactgcttcaaacgctccatcccacgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 44805 - DNA, 408 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcggacttcgctgctacccaaggttgccgggtgacgcacaccgtggaaacggatgaaggagaactcaagaaagcaatcccacctcactgcttcaaacgctccatccctcgctccttctcctacctcctcttcgacatcctcgtctcctcctccctctaccacctctccacatcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 44806 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatagcccacgagtgcggccaccacgccttcagcgactac

SEQ ID NO: 44807 - DNA, 330 bp, Artificial
  Mutation in BnaC.FAD2.b introduced by TALE nuclease pair BnFAD2_T03
caggatccattggtgcaggtggaagaatgcaagtctctcctccctccagctcccccggaaccaacaccctcacacgcgtcccctgcgagacaccaccattcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 44808 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatccctcactccttctcctacctcctcttcgacatcctcgtctcctcctccctctaccacctctccacagcctacttccatctcctcccccaccctctcccttacctcgcctggcccctctactgggcctgccaaggctgcgtcctaacgggcctctgggtcatcgcccacgaatgcggccaccacgccttcagcgactac

SEQ ID NO: 44809 - DNA, 279 bp, Artificial
  Mutation in BnaC.FAD2.b introduced by TALE nuclease pair BnFAD2_T03
caggatccatgggtgcaggtagaagaatgcaagtctatcctcactccagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcggcctgaccggcgtcggggtcatagcccacgagtgcggccaccacgccttcatcgactac

SEQ ID NO: 44810 - DNA, 347 bp, Artificial
  Mutation in BnaC.FAD2.b introduced by TALE nuclease pair BnFAD2_T03
caggatccatgggtgcaggtcgaagaatgcaagtctctcctccctccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44811 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctccccccccaccctctcccttacctcgcctggcccctctactgggcctgccaaggctgcgtcctaacgggcctctgggtcatcgcccacgaatgcggccaccacgccttcagcgactac

SEQ ID NO: 44812 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactctcggacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44813 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcccctgggtcatagcccacgagtgcggccaccacgccttcagcgactac

SEQ ID NO: 44814 - DNA, 460 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgtctccagcggcggttgccggtgctgtgccaggcccacggcttgaccccccagcaggtggtggccatcgccagcaatggcggtggcaagcaggcgctggagacggtccagcggagaactcaagaaagcaatcccacctcactgcttcaaacgctccgtccctcgctccttctcctacctcccctcccacagcctcgtcccctcctccctctcccacctctccacagcctacttccctctcctccccccccctctcccttccctcccctggcccctctactgggcctgccaaggctgcgtcctaacgggcctctgggtcatagcccacgagtgcggccaccacgccttcagcgactac

SEQ ID NO: 44815 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggaaagcaatcccacctcactgctacaaacgctccatcccacgctccttctcctcttcgacatcatcatctcctcctcggctcctccctctaccacctctccacagcctacttccctctcccttacctcgccttacccctctactgggcctgccaaggctgcgtcctaacgggcctctgggtcatagcccacgagtgcggccaccacgccttcagcgactac

SEQ ID NO: 44816 - DNA, 337 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctgagacctcaagaaagcaatcccacctcactgcttcaaacgctccatcccacgctccttctcctcttcgacatcatcatctcctcctcggctcctcactctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44817 - DNA, 350 bp, Artificial
  Mutation in BnaC.FAD2.b introduced by TALE nuclease pair BnFAD2_T03
caggatccatgggtgcaggtggaagaatgcaagtgtctcctcacaccaaaaagtctgaaaccgacaacatcaagcgcgtaccctgcgagacaccgcccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44818 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44819 - DNA, 336 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 44820 - DNA, 420 bp, Artificial
  Mutation in BnaC.FAD2.b introduced by TALE nuclease pair BnFAD2_T03
caggatccatgggtgcaggtggaagaatgcaattctctcctccctccagctcccccggaaccaacaccctcaaacgcgtcccctgcgagacaccaccattcactccggtccagcggctgttgccaccattattgctggcgatggccaccacctgctggggggtcaagccgtgggcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44821 - DNA, 411 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcaccctgaccctggagtagttgactgatagtgacctgttcgttgcaacaaattgataagcacctcaagaaagcaatcccacctcactgcttcaaacgctccatccctcgctccttctcctacctcctcttcgacatcctcgtctcctcctccctcccccacctccccacagcctacttccctctcctcccccaccctctcccttacctcgcctggcccctctactgggcctgccaaggctgcgtcctaacgggcctcggggtcatcgcccacgaatgcggccaccacgccttcagcgactac

SEQ ID NO: 44822 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaactcctccctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 44823 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44824 - DNA, 347 bp, Artificial
  Mutation in BnaC.FAD2.b introduced by TALE nuclease pair BnFAD2_T03
caggatccatgggtgcaggtggaagaatgcaagtctctactccctccagctctcccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44825 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44826 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 44827 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtaccctgcgagacaccgcccttcactgtagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44828 - DNA, 349 bp, Artificial
  Mutation in BnaC.FAD2.b introduced by TALE nuclease pair BnFAD2_T03
caggatccatgggtgcaggtggaagaatgcaagtgtatcctccctccaaaaagtctgaaaccgacaacatcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctggcccctctactgggcctgccaaggcggcgacctaacgggcttctgggtcattgcccacgtgtgtgtcctccgcgcatgcagggactac

SEQ ID NO: 44829 - DNA, 334 bp, Artificial
  Mutation in BnaC.FAD2.b introduced by TALE nuclease pair BnFAD2_T03
caggatccatgggtgcaggtggaagaatgcaagtctctcctccctccagctccccgaaaccaaaaccctcaaacgcgtcccctgcgagacaccacccttcactgagacctcaagaaagcaatcccacctcactgcttcaaacgctccatcccacgctccttctcctcttcgacatcgtcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44830 - DNA, 405 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactccggtccagcggctgttgccaccattattgctggcgatggccaccacctgctggggggtcaagccgtgggcagacctcaagaaagcaatcccacctcactgcttcaaacgctccatcccacgctccttctcctcttcgacatcatcctcccctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44831 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttaactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtccaacgggcctctgggtcatcgcccacgaatgcggccaccacgccttcagcgactac

SEQ ID NO: 44832 - DNA, 450 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggtgttggcttaacgcaacgatgtgcgcgtgtgtaaacccgtggccgaccagtgcctcgtggtgcaggtggtggccatcgccagccacgatggcggcaagtaggcgctggagagacctcaagaaagcaatcccacctcactgcttcaaacgctccctcccacgctccttctcctctccgacatcatcatctcctcctcggctcctccctctcccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 44833 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgtcaaggctgcgtcctaacgggcctctgggtcatagcccacgagtgcggccaccacgccttcagcgactac

SEQ ID NO: 44834 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccacggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44835 - DNA, 370 bp, Artificial
  Mutation in BnaC.FAD2.b introduced by TALE nuclease pair BnFAD2_T03
caggatccatgggtgcaggtagaagaatgcaagtctctcctccctccagctcccccggaaccaacaccctaaaacgcgtcccctgcgagacaccaccattcactctgcgatggcggcaagcaggcgctggagaagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctcctgggcctgccaaggctgcgtcctaacgggcctctgggtcatagcccacgagtgcggccaccacgccttcagcgactac

SEQ ID NO: 44836 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagggcggccaccacgccttcagcgactac

SEQ ID NO: 44837 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgtagagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44838 - DNA, 321 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 44839 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggccggccaagggtgcgtcctaaccggcgtctgggtcatagcccacgagtgcggccaccacgccttcagcgactac

SEQ ID NO: 44840 - DNA, 336 bp, Artificial
  Mutation in BnaC.FAD2.b introduced by TALE nuclease pair BnFAD2_T03
caggatccatgggtgcaggtggaagaatgcaagtctctcctcactccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccaccactccacagcctacttccctctcccttacctcgcctgacccctctactgggcctgccaaggctgcgtcctaacgggcctctggggcatcgcccacgaatgcggccaccacgccttcagcgactac

SEQ ID NO: 44841 - DNA, 459 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgcgttgaccaacggccacctcgtcgccttggcctgcctcggcgggcgtcctgcgctggatgcagtgaaaaagggattggggggtcctatccgccgttcccagctggtgaagtccgagctgcggagaactcaagaaagcaatcccacctcactgcttcaaacgctccatcccacgctccttctcctcttcgacatcatcatctcctcctcggctcctccctctaccacctccccacagcctacttccctctcccttacctcgcctgacccctctactgggcctgccaaggctgcgtcctaacgggcctctgggtcatagcccacgagtgcggccaccacgccttcagcgactac

SEQ ID NO: 44842 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctacctctccacagcctacttccctctcccttacctcgcctgacccctctactgggcctgccaaggctgcgtcctaacgggcctctgggtcatagcccacgagggcggccaccacgccttcagcgactac

SEQ ID NO: 44843 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgtggccaccacgccttcagcgactac

SEQ ID NO: 44844 - DNA, 350 bp, Artificial
  Mutation in BnaC.FAD2.b introduced by TALE nuclease pair BnFAD2_T03
caggatccatgggtgcaggtggaagaatgcaagtgtctcctccctcaaagaagtctgaaaccgacaccatcaagcgcgtaccctgcgagacaccgcccttcactgtagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctcgcccctctactgggccggccaaggctgcgtccgaacgggcctctgggtcatcgcccacgaatgcggccaccacgccttcaacgactac

SEQ ID NO: 44845 - DNA, 373 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgcgttatcccctgattctgtggataaccgtattaccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcaactac

SEQ ID NO: 44846 - DNA, 335 bp, Artificial
  Mutation in BnaC.FAD2.b introduced by TALE nuclease pair BnFAD2_T03
caggatccatgggtgcagctggaagaatgcaagtctctcctccctccagctcccccggaaccaacaccctcaaacgcgtcccctgcgagacaccaccattcactcggacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagtgactac

SEQ ID NO: 44847 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctctgggtcatcgcccacgaatgcggctaccacgccttcagcgactac

SEQ ID NO: 44848 - DNA, 350 bp, Artificial
  Mutation in BnaC.FAD2.b introduced by TALE nuclease pair BnFAD2_T03
caggatcaatgggtgcaggtggaagaatgcaagtctctcctccctccagctcccccgaaaccaaaaccctcaaacgcgtcccctgcgagacaccacccttcactctaaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 44849 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44850 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgccctaacgggcctctgggtcatcgcccacgaatgcggccaccacgccttcagcgactac

SEQ ID NO: 44851 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 44852 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctagacctcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctgacccctctacggggcctgccaaggctgcgtcctaacgggcctctgggtcatagcccacgagtgcggccaccacgccttcagcgactac

SEQ ID NO: 44853 - DNA, 334 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44854 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44855 - DNA, 291 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 44856 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgtgtcatagcccacgagtgcggccaccacgccttcagcgactac

SEQ ID NO: 44857 - DNA, 337 bp, Artificial
  Mutation in BnaC.FAD2.b introduced by TALE nuclease pair BnFAD2_T03
caggatccatgggtgcaggtggaagaatgcaagtctctcccccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctggggcatagcccacgagtgcggccaccacgccttcagcgactac

SEQ ID NO: 44858 - DNA, 293 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44859 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44860 - DNA, 352 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44861 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaattcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtccgaacgggcctctgggtcatagcccacgagtgcgtccaccacgccttcagcgactac

SEQ ID NO: 44862 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44863 - DNA, 395 bp, Artificial
  Mutation in BnaC.FAD2.b introduced by TALE nuclease pair BnFAD2_T03
caggatccatgggtgcaggtggaagaatgcaagtctctcctccctccagctccccggaaccaacaccctcaaacgcgtcccctgcgagacaccaccattcactagttgccggtgctgtgccaggcccacggcttgaccccccagcaggtggtggccatcgccagcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 44864 - DNA, 407 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgtggacaccaaggcctactccggcggctacaacctgcccatcggccaggccgacgaagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44865 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgtccttcactggaactcaagtaagcaatcccacctcactgcttcaaacgaaacatcccacgctccttctcctcttcgacatcatcatctcctcctccgctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44866 - DNA, 327 bp, Artificial
  Mutation in BnaC.FAD2.b introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcatcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggccggccaaggctgcggcctaacgggcctctgggtcatagcccacgagtgcggccaccacgccttcagcgactac

SEQ ID NO: 44867 - DNA, 344 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctcgggaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44868 - DNA, 346 bp, Artificial
  Mutation in BnaC.FAD2.b introduced by TALE nuclease pair BnFAD2_T03
caggatccatgggtgcagggagaagaatgcaagtctctcctccctccagctcccccgaaaccaaaaccctcaaacgcgtcccctgcgcgacaccacccttcacgacctcaagaaagcaatcccacctcactgcttcaaacgctccatccctcgctccttctcctacctcctcttcgacatcctcgtctcctcctccctctaccacccctccacagcctacttccctctcctccccctccctctcccttacctcgcctggcccctctactggtcctgccaaggctgcgtcctaacgggtctcttggtcatcgcccacgaatgctgccgccacgcctccatcgactcc

SEQ ID NO: 44869 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctaccttacctcgcctggcccctctactgggcctgccaaggctgcgtcctaacgggcctctgggtcatcgcccacgaatgcggccaccacgccttcagcgactac

SEQ ID NO: 44870 - DNA, 322 bp, Artificial
  Mutation in BnaC.FAD2.b introduced by TALE nuclease pair BnFAD2_T03
caggatccatgggtgcaggtggaagaatgcaagtctctcctcactccagctcccccggaaccaacaccctcaaaacgcgtcccctgttatcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44871 - DNA, 377 bp, Artificial
  Mutation in BnaC.FAD2.b introduced by TALE nuclease pair BnFAD2_T03
caggatccatgggtgcaggtggaagaatgcaagtctctcctccctcaagctcccccgaaaccaaaaccctcaaacgcgtcccctgcgagacaccacccttcactctaggcgacgaggtggtcgttggtcaacgcggccaacgccgggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44872 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacacaacccttcactgtaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgtcaaggctgcgtcctaacgggcctctgggtcatagcccacgagtgcggccaccacgccttcagcgactac

SEQ ID NO: 44873 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgtgtcctaacgggcctctgggtcatagcccacgagtgcggccaccacgccttcagcgactac

SEQ ID NO: 44874 - DNA, 347 bp, Artificial
  Mutation in BnaC.FAD2.b introduced by TALE nuclease pair BnFAD2_T03
caggatccatgggtgcaggtggaagaatgcaagtgtctcccccctccaaaaagtctgaaaccgacaacatcaagcgcgtaccctgcgagacaccaccattcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccctacttcgcctggcctctctactgggcctgccagggctgcgtcctaaccggcgtctgggtcatagcccacgagtgcggccaccacgccttcagcgactac

SEQ ID NO: 44875 - DNA, 331 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaatcccaccgcactgtttcaaacgctcgatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44876 - DNA, 322 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44877 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaccctcaagaaagcaatcccacctcactgcttcaaacgctccatcccacgctccttctcctcttcgacatcatcatctcctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 44878 - DNA, 343 bp, Artificial
  Mutation in BnaC.FAD2.b introduced by TALE nuclease pair BnFAD2_T03
caggatccatgggtgcaggtggaagaatgcaagtgtctcatccctccaaaaagtctgaaaccgacaacatcaagcgcgtaccctgcgagacaccatcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44879 - DNA, 404 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgctggcgatggccaccacctgctggggggtcaagccgtgggcctggcacagcaccggcaacagccgctggacccacctcactgcttcaaacgctccatccctcgctccttctcctacctcctcttcgacatcctcgtctcctcctccctctaccacctctccacagcctacttccctctccccccccaccctctcccttacctcgcctggcccctctactgggcctgccaaggctgcgtcctaacgggcctctgggtcatcgcccacgaatgcggccaccacgccttcagcgactac

SEQ ID NO: 44880 - DNA, 368 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgagcgccatctcgaaccgacgttgctggccgagacctcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44881 - DNA, 404 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctcggcggatttgtcctactcaggagagcgttcaccgacaaacaacagataaaacgaaaggctcagtctttgacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44882 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 44883 - DNA, 440 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggaccgtctcagcggctgttgccaccgccattgctggcgatggccaccacctgctggtagcggtggtttttttgtttgcaagcagcagattacgcgcagaaggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44884 - DNA, 346 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctgcgagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44885 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcacttacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44886 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagatagcaatcccacctcactgcttcaaacgctccatcccacgctccttctcctcttcgacatcatcatctcctcctcggctcctccctctaccacctctccacagcctacttccctctcccttacctcgcctgaccccgctactgggcctgccaaggctgcgccctaacgggcccctgggtcatagcccacgagtgcggccaccacgcctgcagcgactac

SEQ ID NO: 44887 - DNA, 295 bp, Artificial
  Mutation in BnaC.FAD2.b introduced by TALE nuclease pair BnFAD2_T03
caggatccatgggtgcaggtggaagaatgcaagtctctactccctccaactcccccggaaccaaaaccctccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 44888 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcgaacgcgtcccctgcgagacaccacccttcactctaaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44889 - DNA, 335 bp, Artificial
  Mutation in BnaC.FAD2.b introduced by TALE nuclease pair BnFAD2_T03
caggatccatgggtgcaggtggaagaatgcaagtgtctactccatccaagaagtctgaaaccgacaccatcaaacgcgtcccctgcgagacaccacccttcactcagacctcaagaaagcaatcccacctcactgcttcaaacgctccatcccacgctccttctcctcttcgacatcatcatctcctcctcggcacctccctctaccacctctccacagcctacttccctctcccttacctcgcctgacccctctactgggcctgccaaggctgcgtcctaacgggcctctgtgtcatagcccacgagtgcggccaccacgccttcagcgactac

SEQ ID NO: 44890 - DNA, 328 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcggggtcatagcccacgagtgcggccaccacgccttcagcgactac

SEQ ID NO: 44891 - DNA, 344 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttagacctcaagaaagcaatcccacctcactgcttcaaacgctccatccctcgctccttctcctacctcctcttcgacatcctcgtctcctcctccctctaccacatctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44892 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44893 - DNA, 333 bp, Artificial
  Mutation in BnaC.FAD2.b introduced by TALE nuclease pair BnFAD2_T03
caggatccatgggtgcaggtggaagaatgcaagtctctcctccctcaagctcccccgaaaccaaaaccatcaaacgcgtcccctgcgagacaccacccttcactgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcggcctaacgggcctctgggtcatagcccacgagtgcggccaccacgccgtcagcgactac

SEQ ID NO: 44894 - DNA, 375 bp, Artificial
  Mutation in BnaC.FAD2.b introduced by TALE nuclease pair BnFAD2_T03
caggatccagggtgcaggtgaaagaatgcaagtctctcctccatccagctcccccggaaccaacaccctcaaacgcgtcccctgcgagacaccaccattcactctggtggccatcgccagcaatggcggtggcaacagccgctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44895 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44896 - DNA, 403 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaagcgcgtaccctgcgagacaccacccttcactcttgctggcgatggccaccacctgctggggggtcaagccgtgggcctggcacagcaccggcaacagccgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44897 - DNA, 347 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccaccattcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44898 - DNA, 369 bp, Artificial
  Mutation in BnaC.FAD2.b introduced by TALE nuclease pair BnFAD2_T03
caggatccatgggtgcaggtggaagaatgcaagtctctcccccctccagctcccccggaaccaacaccctcaaacgcgtcccctgcgaggcccacggcttgaccccggagcaggtggtggccatcgccagccacgatggagacctcaagaaagcaatcccacctcactgcttcaaacgctccatcccacgctccttctcctcttcgacatcatcatctcctcctcggctcctccctctaccacctctccacagccttcttccctctcccttaccgcgcctgacccctctactgggccggccaaggctgcggctgaacgggcctcggggtcatcgcccacgaatgcggcgaccacgccttcagcgactac

SEQ ID NO: 44899 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44900 - DNA, 323 bp, Artificial
  Mutation in BnaC.FAD2.b introduced by TALE nuclease pair BnFAD2_T03
caggatacatgggtgcaggtggaagaatgcaagtgtctcctccctccaagaagtctgaaaccgacaccatcaaacgcgtcccctgcgagacggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44901 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcacacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44902 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggccggccaaggctgcgtcctaacgggcctctgggtcatcgcccacgaatgcggccaccacgccttcagcgactac

SEQ ID NO: 44903 - DNA, 345 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgctcaagaaagcaatcccaccgcactgtttcaaacgctccatccctcgctccttctcctacctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44904 - DNA, 411 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcgctttccagtcgggaaacctgtcgtgccagctgcattaatgaatcggccaacgcgcggggagaggcggtttgcgtgaactcaagaaagcaatcccccctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 44905 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44906 - DNA, 370 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttccccggagcaggtggtggccatcgccagcaatattggtggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcggggtcatagcccacgagtgcgtccaccacgccttcagcgactac

SEQ ID NO: 44907 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44908 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccctgacctcaagaaagtaatcccacctcactgcttcaaacgctccatccctcgctccttttcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44909 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44910 - DNA, 396 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcggttcctggccttttgctggccttttgctcacatgttctttccggagaactcaagaaagcaatcccaccgcactgcttcaaacgctccatccctcgctccttctcctacctcctcttcgacatcctcgtctcctcctccctctacctcctctccaccgcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44911 - DNA, 350 bp, Artificial
  Mutation in BnaC.FAD2.b introduced by TALE nuclease pair BnFAD2_T03
caggatccatgggtgcaggtggaagaatgcaagtgcatcatccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcctcgtcgacatcctcgtctcctcctccctctaccacctctccacagcctacttccctctcctccccccccctctcccttacctcacctggcccctctactgggccggccgaggctgcgtccgaacgggcctcggggtcatcgcccacgaatgcggcctccgcgccatcagcgactac

SEQ ID NO: 44912 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcattgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44913 - DNA, 351 bp, Artificial
  Mutation in BnaC.FAD2.b introduced by TALE nuclease pair BnFAD2_T03
caggatccatgggtgcaggtggaagaatgcaagtttatagtcactcaagctcccccggaaccaacaccataaaacgcgtccccagcgagacaccaccattcactctagacctcaagaaagcaatcccacctcactgctacaaacgctccatcccacgctccttctcctcttcgacatcatcatctcctcctcggctcctccctctaccaacgctccacagcctacttccctctcctcccccaccctctcccttacctcgcctagcccctctcctgggcctgccaaggctgctgcttaacgggcctctgtgtcatcgcccacgaatgcgccctccacgccttcagcgactac

SEQ ID NO: 44914 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcttcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 44915 - DNA, 350 bp, Artificial
  Mutation in BnaC.FAD2.b introduced by TALE nuclease pair BnFAD2_T03
caggatccatgggtgcaggtggaagaatgcaagtgtctcctccctccagaaagtctgaaaccgacaccatcaaacgcgtcccctgcgagacaccacccttcactctagacctcaagaaaacaatcccacctcactacttcaaacgctccatccctcgctccttctcctacctcctcttctacatcctcgtctcctcctccctctaccacctctccacagcctacttccctctcctccccccccctctcccttacctcgcctggcccctctactgggcctgccaagggtgcgtcctaaccggcgtctgggtcatagcccacgagtgcggccaccacgccttcagcgactac

SEQ ID NO: 44916 - DNA, 281 bp, Artificial
  Mutation in BnaC.FAD2.b introduced by TALE nuclease pair BnFAD2_T03
caggatccatgggtgcaggtggaagaatgcaagtctcgacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 44917 - DNA, 334 bp, Artificial
  Mutation in BnaC.FAD2.b introduced by TALE nuclease pair BnFAD2_T03
caggatccatgggtgcagggggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44918 - DNA, 334 bp, Artificial
  Mutation in BnaC.FAD2.b introduced by TALE nuclease pair BnFAD2_T03
caggatccatgggtgcaggcggaagaatgcaagtctctcctcactccagctcccccggaaccaacaccctcaaacgcgtcccctgcgagacaccaccattcactctccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagggcggccaccacgccgtcagcgactac

SEQ ID NO: 44919 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacaagacctcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44920 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 44921 - DNA, 343 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44922 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccaagagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44923 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 44924 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttgcctcgcctggcccctctactgggcctgccaaggctgcgtcctaacgggcctctgggtcatcgcccacgaatgcggccaccacgccttcagcgactac

SEQ ID NO: 44925 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtactaacgggcctctgggtcatcgcccacgaatgcggccaccacgccttcagcgactac

SEQ ID NO: 44926 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccacaacgccttcagcgactac

SEQ ID NO: 44927 - DNA, 386 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcggcaccggcaacagccgctggaccgtctccagcgcctgcttgccaccagagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44928 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44929 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44930 - DNA, 349 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgggaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44931 - DNA, 415 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcaactatcgtcttgagtccaacccggtaagacacgacttatcgccactggcagcagccactggtaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44932 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 44933 - DNA, 335 bp, Artificial
  Mutation in BnaC.FAD2.b introduced by TALE nuclease pair BnFAD2_T03
caggatccatgggtgcaggtggaagaatgcaagtctttactcactccagctcccccggaaccaacaccctcaaacgcgtcccctccgtggcaccaccactcactcagacctcaagaaagcaatcccacctcactgcttcaaacgctccatcccacgctccttctcctcttcgacaacatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccgtcaccgactac

SEQ ID NO: 44934 - DNA, 342 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 44935 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcacctcaagaaagcaatcccacctcactgcttcaaacgctccatcccacgctccttctcctcttcgacatcatcatctcctcctcggctcctccctctaccacctctacacagcctacttccctctcccttacctcgcctggcccctctactgggcctgccaaggctgcgtcctaacgggcctctgggtcatagcccacgagtgcggccaccacgccttcagcgactac

SEQ ID NO: 44936 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaagacctcaagaaagcaatcccacctcactgcttcaaacgctccatcccacgctccttctcctctccgacatcatcatctcctcctcggctcctccctctaccacctccccacagcctacttccctctcccttacctcgcctgacccctctactgggcctgccaaggctgcgtcctaacgggcctctgggtcatagcccacgagtgcggccaccacgccttcagcgactac

SEQ ID NO: 44937 - DNA, 348 bp, Artificial
  Mutation in BnaC.FAD2.b introduced by TALE nuclease pair BnFAD2_T03
caggatccatgggtgcaggtggaagaatgcaagtctctcctcactccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44938 - DNA, 376 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcacttccgtgggcctggcacagcaccggcaacagccgctggagacgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44939 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggccttccaaggctgcgtcctaacgggcctctgggtcatcgcccacgaatgcggccaccacgccttcagcgactac

SEQ ID NO: 44940 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcagagacctcaagaaagcaatcccacctcactgcttcaaacgctccatcacacgctccttctcctcttcgacatcatcatctcctcctcggctcctccctctaccacctctccacagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 44941 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacacctcaataaagcaatcccacctccctccttcaaccgccccatccctcgctccttctcccacctcctcttcgacatcctcgtctcctcctccctctaccaccgctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 44942 - DNA, 295 bp, Artificial
  Mutation in BnaC.FAD2.b introduced by TALE nuclease pair BnFAD2_T03
caggatccatgggtgcaggtcgaagaatgcaagtctctcctccctccagctcccccgaaaccaaaaccctccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44943 - DNA, 340 bp, Artificial
  Mutation in BnaC.FAD2.b introduced by TALE nuclease pair BnFAD2_T03
caggatccatgggtgcaggtggaagaatgcaagtgtctcctccatcaaagaagtctgaaaccgacaacatcaagcgcgtaccctgcgagacaccgcccttcactgaactcaagaaagcaatcccaccgcactgtttcaaacgctcgatccctcgctctttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccacaacgccttcagcgactac

SEQ ID NO: 44944 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgtggccaccacgccttcagcgactac

SEQ ID NO: 44945 - DNA, 336 bp, Artificial
  Mutation in BnaC.FAD2.b introduced by TALE nuclease pair BnFAD2_T03
caggatccatgggtgcaggtggaagaatgcaagtccctcctccctccagctcccccgaaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44946 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggcaaccacgccttcagcgactac

SEQ ID NO: 44947 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccaccgcactgtttcaaacgctcgatccctcgctctttctcctacctcatctgggacatcatcatagcctcctgcttctactacgtcgccaccacttacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 44948 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcacttacctcaagaaagcaatcccacctcactgcttcaaacgctccatcccacgctccttctcctcttcgacatcatcatctcctcctcggctcctccctctaccacctctccacagcctacttccctctcccttacctcacccgacccctctactgggcctgccaaggctgcgtcctaacgggcctctgggtcatagcccacgagtgcggccaccacgccttcagcgactac

SEQ ID NO: 44949 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtctcctgcgagacaccaccattcactctgacctcaagaaagcaatcccacctcactgcttcaaacgctccatcccacgctccttctcctcttcgacatcatcatctcctcctcggctcctccctctaccaccactccacagcctacttccctctcccttacctcgcctgacccctctactgggcctgccaaggctgcgtcctaacgggcctctgggtcatagcccacgagtgcggccaccacgccttcagcgactac

SEQ ID NO: 44950 - DNA, 451 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgaggcaccaccattcactcagggggtcaagccgtgggcctggcacagcaccggcaacagccgctggacgaagactgggcctttcgttttatctgttgtttgtcggtgaacgctctcctgagtaggacaaatccggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44951 - DNA, 434 bp, Artificial
  Mutation in BnaC.FAD2.b introduced by TALE nuclease pair BnFAD2_T03
caggatccatgggtgcaggaggaagaatgcaagtctctcctccctccagctcccccggaaccaacaccctcaaacgcgtcccctgcgagacaccaccattcactctcggcaacagccgctggaccgtctccagcgcctgcttgccaccattattgctggcgatggccaccacctgccatcccacgttccagacctcaagaaagcaatcccacctcactgcttcaaacgctccatcccacgctccttctcctcttcgccatcatcatctcctcctcggctcctccctctaccacctctccacagcctacttccctcccctccccccccctctcccttacctcgcctggcccctctactgggcctgccaaggctgcgtcctaacgggcctctgggtcatagcccacgagtgcggccaccacgccttcagcgactac

SEQ ID NO: 44952 - DNA, 278 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 44953 - DNA, 370 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctcggtggataaccgtattaccgcctttgagtgagctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 44954 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccccgcgagacaccaccattcacttagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44955 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcatcgactac

SEQ ID NO: 44956 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44957 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttttggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44958 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttagacctcaagaaagcaatcccacctcactgcttcaaacgctccatccctcgctccttctcctacctcctcttcgacatcctcgtctcctcctccctctaccacctctccacagcctacttccctctcctccctcaccctctcccttgcctcgcctggcctctctactgggcctgccagggctgcgtcctaaccggcgtctgggtcatagcccacgagtgcggccaccacgccttcagcgactac

SEQ ID NO: 44959 - DNA, 384 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtggataaccgtattaccgcctttgagtgagctgacctcaagaaagcaatcccacctcactgcttcaaacgctccatccctcgctccttctcctacctcctcttcgacatcctcgtctcctcctccctctaccacctctccacagcctacttccctctccgcccccaccctctcccttacctcgcctggcccctctactgggcctgccaaggctgcgtcctaacgggcctctgggtcatcgcccacgaatgcggccaccacgccttcagcgactac

SEQ ID NO: 44960 - DNA, 382 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctctgagcctttcgttttatctgttgtttgtcggtgaacgctctcctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44961 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagactccacccttcactctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44962 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcacggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44963 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44964 - DNA, 307 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44965 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44966 - DNA, 331 bp, Artificial
  Mutation in BnaC.FAD2.b introduced by TALE nuclease pair BnFAD2_T03
caggatccatgggtgcaggtggaagaatgcaagtgtctcctcactccagctcccccggaaccaacaccctcaaacgcgtcccctgcgagacaccaccattcacttatcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcggggtcatagcccacgagtgcggccaccacgccttcagcgactac

SEQ ID NO: 44967 - DNA, 419 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaggataaaattgtagctgggtgcaaaatagcaactaatcttgatttaaggcttcaaaacctcccgcaagtcgggaggttcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44968 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcggggtcatcgcccacgaatgcggcgaccacgccttcagcgactac

SEQ ID NO: 44969 - DNA, 354 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgggaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgtggccaccacgccttcagcgactac

SEQ ID NO: 44970 - DNA, 334 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtcccctgcgagacaccacccttcactgaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcatcgactac

SEQ ID NO: 44971 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcggcctaacgggcctctgggtcatagcccacgagtgcggccaccacgccttcagcgactac

SEQ ID NO: 44972 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccacctcactgcttcaaacgctccatcccacgctccttctcctcttcgacatcatcatcccctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44973 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttagacctcaagaaagcaatcccacctcactgcttcaaacgctccatcccacgctccttctcctcttcgacatcatcatctcctcctcggctcctccctctaccacctctccacagcctccttccctctcccttacctcgcctgacccctctactgggcctgccaaggctgcgtcctaaccggcgtctgggtcatagcccacgagtgcggccaccacgccttcagcgactac

SEQ ID NO: 44974 - DNA, 348 bp, Artificial
  Mutation in BnaC.FAD2.b introduced by TALE nuclease pair BnFAD2_T03
caggacccatgggtgcaggtggaagaatgcaagtctctactcactccagctcccccggaaccaacaccctaaaacgcgtcccctgcgagacaccaccattcacaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44975 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctaccttacctcgcctggcccctctactgggcctgccaaggctgcgtcctaacgggcctctgggtcatcgcccacgaatgcggccaccacgccttcagcgactac

SEQ ID NO: 44976 - DNA, 367 bp, Artificial
  Mutation in BnaC.FAD2.b introduced by TALE nuclease pair BnFAD2_T03
caggatccatgtgcaggtggacgaatgcaagtctctcctccctccagctcccccggaaccaacaccctcaaacgcgtcccctgcgaggcccacggcttgaccccggagcaggtggtggccatcgccagccacgatggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 44977 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44978 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctcacgggcctctgggtcatagcccacgagtgcggccaccacgccttcatcgactac

SEQ ID NO: 44979 - DNA, 324 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtagaactcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 44980 - DNA, 324 bp, Artificial
  Mutation in BnaC.FAD2.b introduced by TALE nuclease pair BnFAD2_T03
caggatccatgggtgcaggtggaagaatgcaagtctatactccctccagctcccccgaaaccaaaaccctcaaacgcgtcccctgcgagacaccacccttcaagaaagcaatcccacctcactgcttcaaacgctccatcccacgctccttctcctcttcgacatcatcatctcctcctcggctcctccctctaccacctctccacagcctacttccctctctcctacttcgcctggcctctctactgggcctgccagggctgcgtcctaaccggcgtctgggtcatagcccacgagtgcggccaccacgccttcatcgactac

SEQ ID NO: 44981 - DNA, 333 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccaccattcactaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcggcctaacgggcctctgggtcttagcccacgagtgcggcctccacgccttcagcgactac

SEQ ID NO: 44982 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaatgggcctctgggtcatcgcccacgaatgcggccaccacgccttcagcgactac

SEQ ID NO: 44983 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaagacctcaagaaagcaatcccacctcactgcttcaaacgctccatcccacgctccttctcctcttcgacatcatcatctcctcctcggctcctccctctaccacctctccacagcctacttccctctcccttacctcccctgacccctccactgggcctgccaaggctgcgtcctaacgggcctctgggtcatagcccacgagtgcggccaccacgccttcagcgactac

SEQ ID NO: 44984 - DNA, 336 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcatcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44985 - DNA, 349 bp, Artificial
  Mutation in BnaC.FAD2.b introduced by TALE nuclease pair BnFAD2_T03
caggatccatgggtgcaggtggaagaatgcaagtctctcctccctacagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44986 - DNA, 318 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcctcccctgcgagacaccacctcactgcttcaaacgctccatctcacgctccttctcctcttcgacatcatcatctcctcctcagctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 44987 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44988 - DNA, 335 bp, Artificial
  Mutation in BnaC.FAD2.b introduced by TALE nuclease pair BnFAD2_T03
caggatccatgggtgcaggtggaagaatgcaagtctctcctccctccagcttccccgaaaccaaaaccctcaaacgcgtcccctgcgagacaccaccattcactctgacctcaagaaagcaatcccaccgcactgcttcaaacgctccatcccacgctccttctcctcttcgacatcatcatctcctcctcggctcctccctctaccacctctccacagcctccttccctctcccttacctcgcctggcccctctactgggcctgccaaggctgcgtcctaacgggcctctgggtcatagcccacgagtgcggccaccacgccttcagcgactac

SEQ ID NO: 44989 - DNA, 337 bp, Artificial
  Mutation in BnaC.FAD2.b introduced by TALE nuclease pair BnFAD2_T03
caggatccatgggtgcagctggaagaatgcaagtctctcctccctccagctcccccggaaccaacacactcaaaacgcgtcccctgttatcgagacctcaagaaagcaatcccacctcactgcttcaaacgctccatcccacgctccttctcctcttcgacatcatcatctcctcctcggctcctccctctaccacctctccacagcctacttccctcgcctccctcaccctcgctcctacttcgcctggcctctctactgggcctgccagggcagcgtcctaaccggcgtctgggtcatagcccacgagtgcggccaccacgccatcagcgactac

SEQ ID NO: 44990 - DNA, 352 bp, Artificial
  Mutation in BnaC.FAD2.b introduced by TALE nuclease pair BnFAD2_T03
caggatccatgggtgcaggtgaaagaatgcaagtctctcctccctccagctcccccggaaccaacaccctcaaacgcgtcccctgcgagacaccaccattcactctggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 44991 - DNA, 317 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccattcactgtcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44992 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 44993 - DNA, 308 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaccctcaagaaagcaatcccacctcactgcttcaaacgctccatccaacgctccttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcagcgactac

SEQ ID NO: 44994 - DNA, 335 bp, Artificial
  Mutation in BnaC.FAD2.b introduced by TALE nuclease pair BnFAD2_T03
caggatccatgggtgcggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 44995 - DNA, 318 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacaagaaagcaatcccacctcactgcttcaaacgctccatcccacgctccttctcctcttcgacatcatcatctcctcctcggctccttcctctaccacctctccacagcctacttccctctctcctacttcgcctggcctctctactgggcctgccaagggtgcgtcctaaccggcgtctgggtcatagcccacgagtgcggccaccacgccttagcgactac

SEQ ID NO: 44996 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcctcaagaaagcaatcccacctcactgcttcaaacgctccatccctcgctccttctcctacctccccttcgacatcctcatctcctcctccctctaccacctctccacagcctacttccctctcctcccccaccctctcccttacctcgcctggcccctctactgggcctgccaaggctgcgtcctaacgggcctctgggtcatcgcccacgaatgcggccagcacgccttcagcgactac

SEQ ID NO: 44997 - DNA, 337 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 44998 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctcttcacagcctacttccctctcccttacctcgcctgacccctctactgggcctgccaaggctgcgtcctaacgggcctctgggtcatagcccacgagtgcggccaccacgccttcagcgactac

SEQ ID NO: 44999 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 45000 - DNA, 348 bp, Artificial
  Mutation in BnaC.FAD2.b introduced by TALE nuclease pair BnFAD2_T03
caggatccatgggtgcaggtggaagaatacaagtctctccttcctccagctcccccgaaaccaaaaccctcaaacgcgtcccctgcgagacaccacccttcactagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45001 - DNA, 387 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctgtagcggtggtttttttgccggatcaagagctaccaactctttttccgaaggtaactggcttcagcaatcccacctcactgcttcaaacgctccatcccacgctccttctcctcttcgacatcatcatctcctcctcggctcctccctctcccacctctccacagcctacttccctctcccttaccgcgcctgacccctctactgggcctgccaaggctgcggcctgacgggcctctgggtcatcgcccacgaatgcggccaccacgccttcagcgactac

SEQ ID NO: 45002 - DNA, 385 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcaaatatttcttgtcaaaaatgctccactgacgttccataaattcccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45003 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcataaccggcgtctgggtcatagcccacgagtgcggccaccacgccttcagcgactac

SEQ ID NO: 45004 - DNA, 337 bp, Artificial
  Mutation in BnaC.FAD2.b introduced by TALE nuclease pair BnFAD2_T03
caggatccatgggtgcaggtggaagaatgcaagtctctcctccctcaagctcccccggaaccaacaccctcaaacgcgtcccctgcgagacaccaccattcactctcgaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccgtcagcgactac

SEQ ID NO: 45005 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgccccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45006 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccacaccatcaagcgcgtaccctgcgagacaccgcccttcactgtagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 45007 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcccggcccctctactgggcctgccaaggctgcgtcctaacgggcctctgggtcatcgcccacgaatgcggccaccacgccttcagcgactac

SEQ ID NO: 45008 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccacctcactgcttcaaacgctccatcccaccctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaaggcggccaccacgccttcagcgactac

SEQ ID NO: 45009 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 45010 - DNA, 265 bp, Artificial
  Mutation in BnaC.FAD2.b introduced by TALE nuclease pair BnFAD2_T03
caggatccatgggtgcaggtggaagaatgcaagtctctcctccctccagtctctccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcgaccaccacgccttcagcgactac

SEQ ID NO: 45011 - DNA, 257 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatccactctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45012 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45013 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcctccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggtccctctactgggcctgccaaggctgcgtcctaacgggcctctgggtcattgcccacgaatgcggccaccacgccttcagcgactac

SEQ ID NO: 45014 - DNA, 351 bp, Artificial
  Mutation in BnaC.FAD2.b introduced by TALE nuclease pair BnFAD2_T03
caggatccatgggtgcaggcggaagaatgcaagtctctcctccctccagctcccccggaaccaacaccctcaaacgcgtcccctgcgagacaccaccattcactctcgacctcaagaaagcactcccacctcactgcttcaaacgctccatcccacgctccttctcctcttcgacatcatcatctcctcctcggctcctccctctaccacctctccacagcctacttccctctcctcccccaccctctcccttacctcccctggcccctctactgggcctgccaaggctgcgtcctaacgggcctctgggtcatcgcccacgaatgcggccaccacgccttcagcgactac

SEQ ID NO: 45015 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45016 - DNA, 342 bp, Artificial
  Mutation in BnaC.FAD2.b introduced by TALE nuclease pair BnFAD2_T03
caggatccatgggtgcaggtggaagaatgcaagtgtgtcctctctcaaagaagtctgaacccgacaccatcaagcgcttaccctgcgagacaccgcccttaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctggcccctctactgggcctgccaaggctgcgtcctaacgggcctctgggtcatcgcccacgaatgcggccaccacgccttcagcgactac

SEQ ID NO: 45017 - DNA, 345 bp, Artificial
  Mutation in BnaC.FAD2.b introduced by TALE nuclease pair BnFAD2_T03
caggatccatgggtgcagctggaagaatgcaagtgtctcctccctccaagaagtctgaaaccgacaccatcaagcgcgtaccctgcgagacaccgcccttcactctcaagaaagcaatcccaccgcactgtttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45018 - DNA, 339 bp, Artificial
  Mutation in BnaC.FAD2.b introduced by TALE nuclease pair BnFAD2_T03
caggatccatgggtgcaggtggaagaatgcaagtgtatcctccctccagctcccccgaaaccaaaaccctcaaacgagtcccctgcgagacaccacccttcaagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctcggggtcatagcccacgagtgcggccaccacgccttcagcgactac

SEQ ID NO: 45019 - DNA, 343 bp, Artificial
  Mutation in BnaC.FAD2.b introduced by TALE nuclease pair BnFAD2_T03
caggatccatgggtgcaggtggaagaatacaagtctctcctccctccagctcccccggaaccaacaccctcaaacgcgtcccctgcgagacaccaccattcactcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45020 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcacgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgacttac

SEQ ID NO: 45021 - DNA, 334 bp, Artificial
  Mutation in BnaC.FAD2.b introduced by TALE nuclease pair BnFAD2_T03
caggatccatgggtgcaggcagaagaatgcaagtctctcctccctccagctcccccgaaaccaaaaccctcaaacgcgtcccctgcgagacaccaccattcactagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagggactac

SEQ ID NO: 45022 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttaagcgactac

SEQ ID NO: 45023 - DNA, 282 bp, Artificial
  Mutation in BnaC.FAD2.b introduced by TALE nuclease pair BnFAD2_T03
caggatccatgggtgcaggtggaagaatgcaagtctctagacctcaagaaagcaatcccacctcactgcttcaaactctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgcctgcagcgactac

SEQ ID NO: 45024 - DNA, 397 bp, Artificial
  Mutation in BnaC.FAD2.b introduced by TALE nuclease pair BnFAD2_T03
gaggatccatgggtgcaggtggaagaatgcaagtctctcctccctccagctcccccggaaccaacaccctcaaacgcgtcccctgcgagacaccaccattcactcagccgaacgaccgagcgcagcgagtcagtgagcgaggaagcggaagagcgcccaatacgcggagacctcaagaaagcaatcccacctcactgcttcaaacgctccatcccacgctccttctcctcttcgacagcatcatctcctcctcggctcctccctctcccacctctccacagcctacttccctctcccttacctcgcctgacccctctactgggcctgccaaggctgcgtcctaacgggcctctgggtcatagcccacgagggcggccaccacgccttcagcgactac

SEQ ID NO: 45025 - DNA, 333 bp, Artificial
  Mutation in BnaC.FAD2.b introduced by TALE nuclease pair BnFAD2_T03
caggatccatgggtgcaggaggaagaatgcaagtctctcctcactccagctcccccggaaccaacaccctcaaacgcgtccactgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtaatcgcccacgaatgcggccaccacgccttcagcgactac

SEQ ID NO: 45026 - DNA, 413 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcacgcccgccaccctccgggccgttgcttcacaacgttcaaatccgctcccggcggatttgtcctaccggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactc

SEQ ID NO: 45027 - DNA, 376 bp, Artificial
  Mutation in BnaC.FAD2.b introduced by TALE nuclease pair BnFAD2_T03
caggatccatgggtgcaggtggaagaatgcaagtctctcctccctcaagctcccccggaaccaacaccctcaaacgcgtcccctgcgagacaccaccattcactctggtggccatcgccagcaatggcggacccaacagccgccggagaccccaacaaagcaatcccacctcactgctccaaacgctccatcccaccctccttctccccctcgccatcatcatctcctcctcggctcctccccctcccacctccccaccgcctacttccctctcccttacctcgcctgacccctctactgggcctgccaaggctgcgtcctaacgggcctctgggtcatagcccacgagtgcggccaccacgccttcagcgactac

SEQ ID NO: 45028 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctaccgggcctgccaaggctgcgtcctaacgggcctctgggtcatagcccacgagtgcggccaccacgccttcagcgactac

SEQ ID NO: 45029 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcctctgcgagacaccaccattcactcttacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45030 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccccgcgagacaccgcccttcactgtgagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45031 - DNA, 332 bp, Artificial
  Mutation in BnaC.FAD2.b introduced by TALE nuclease pair BnFAD2_T03
caaggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctccccccccaccctctcccttacctcgcctggcccctctactgggcctgccaaggctgcgtcctaacgggcctctgggtcatcgcccacgaatgcggccaccacgccttcagcgactac

SEQ ID NO: 45032 - DNA, 350 bp, Artificial
  Mutation in BnaC.FAD2.b introduced by TALE nuclease pair BnFAD2_T03
caggatccatgggtgcaggaggaagaatgcaagtgtctcctccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45033 - DNA, 329 bp, Artificial
  Mutation in BnaC.FAD2.b introduced by TALE nuclease pair BnFAD2_T03
caggatccatgggtgcaggtggaagaatgcaagtctctcctcaatccagctcccccggaaccaacagcctcaaaacgcgtcccctgttatcgagacctcaagaaagcaatcccacctcactgcctcaaacgctccatcccacgctccttctcctcttcgacatcatcatctcctcctccctctaccacctctccacagcctacttccctctcctcccccacccgctcccttacctcgcctggcccctctactgcgcctgccaaggctgcgtcctaacgggcctctgggtcatcgcccacgaatgcggccaccacgccttcagcgactac

SEQ ID NO: 45034 - DNA, 332 bp, Artificial
  Mutation in BnaC.FAD2.b introduced by TALE nuclease pair BnFAD2_T03
caggatccatgggtgcaggtggaagaatgcaagtgtcccctccatccagctcccccggaaccaacaccctcaaacgcgtcccctgcgagacaccaccattcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 45035 - DNA, 340 bp, Artificial
  Mutation in BnaC.FAD2.b introduced by TALE nuclease pair BnFAD2_T03
caggatccatgggtgcaggaggaagaatgcaagtctctcatccctccagctcccccgaaaccaaaaccctcaaacgcgtcccctgcgagacaccacccttcacagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45036 - DNA, 336 bp, Artificial
  Mutation in BnaC.FAD2.b introduced by TALE nuclease pair BnFAD2_T03
caggatccatgggtgcaggtgaaagaatgcaagtctctactccctccagctcccccggaaccaacaccctccaacgcgtcccctgcgagacaccaccattcactcgagacctcaagaaagcaatcccacctcactgcttcaaacgctccatcccacgctccttctcctcttcgacaccatcatctcctcctcggctcctccctctaccacctctccacagcctacttccctctcccttccctcgcctgacccctctactgcgcctgccaaggctgcgtcctaacgggcctctgggtcatagcccacgagtgcggccagcacgccttcagcgactac

SEQ ID NO: 45037 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttatcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45038 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 45039 - DNA, 373 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggcggcaagcaggcgctggaggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45040 - DNA, 350 bp, Artificial
  Mutation in BnaC.FAD2.b introduced by TALE nuclease pair BnFAD2_T03
caggatccatgggtgcaggtggaagaatgcaagtctctcctccctccagcaaccccgaaaccaaaaccatcaaacgcgtcccctgcgagacaccacccttcactctagaactcaagaaagcaatccccccacactgcttcaaacgatccatcccccgctccttctcctacctcctcttcgacatcctcgtcgcctcctccttctactacgactccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45041 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaacaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 45042 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctccctgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45043 - DNA, 336 bp, Artificial
  Mutation in BnaC.FAD2.b introduced by TALE nuclease pair BnFAD2_T03
caggatccatgggtgcaggtggaagaatgcacgtgtctcctccctccaaaaagtctgaaaccgacagcatcaagcgcgtaccctgcgagacaccacccttcactctgagacctcaagaaagcaatcccacctcactgcttcaaacgctccatccctcgctccttctcctacctcctcttcgacatcctcgtctcctcctccctctacctcctctccacagcctacttccctctcccttacctcgcctgacccctctactgggcctgccaaggctgtgtcctaacgggcccctgggtcataacccacgagtgctgccaccacgccttcagcgcctac

SEQ ID NO: 45044 - DNA, 416 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtaccctgcgaaacaccgcccttccatttggtacaccgccctacaccgcccttcacacgcccgccataaactgccaggcatcaaactaagcagaaggccatcctgacggagaactcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45045 - DNA, 337 bp, Artificial
  Mutation in BnaC.FAD2.b introduced by TALE nuclease pair BnFAD2_T03
caggatccatgggtgcaggtggaagaatgcaagtctctcctccctccggctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45046 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagaccccacccttccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccgggccctctactgggcctgccaaggctgcgtcctaacgggcctctgggtcatagcccacgagtgcggccaccacgccttcagcgactac

SEQ ID NO: 45047 - DNA, 439 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgtccagcggctgttgccggtgctgtgccaggcccacggcttgaccccggagcaggtggtggccatcgccagcaatattggtggcaagcaggcgctggcacaaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45048 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45049 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgcctcaagaaagcaatcccacctcactgcttcaaacgctccatccctcgctccttctcctacctcctcttcgacatcctcgtctcctcctccctctaccacctctccacagcctacttccctctcctcccccaccctctcccttgccgcgcctggcccctctacggggcctgcctaggctgcggcctaacgggcctctgggtcatcgcccacgaatgcggccaccacgccttcagcgactac

SEQ ID NO: 45050 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatgctccttaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagggcggccaccacgccttcagcgactac

SEQ ID NO: 45051 - DNA, 319 bp, Artificial
  Mutation in BnaC.FAD2.b introduced by TALE nuclease pair BnFAD2_T03
caggatccatgggtgcaggtggaagaatgcaagtctctcctccctccagctccccgaaaccaaaaccctcaaacgcgtcccctgcgagacaccactattcactctatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45052 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccctgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggcggcgtcctaacgggcctctgggtcatcgcccacgaatgcggccaccacgccttcagcgactac

SEQ ID NO: 45053 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaagcgcgtaccctgcgagacaccgcccttcactgtagaactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45054 - DNA, 390 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgccaggcccacggcttgaccccggagcaggtggtggccatcgcgtcgattttgtagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45055 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgcgccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45056 - DNA, 409 bp, Artificial
  Mutation in BnaC.FAD2.b introduced by TALE nuclease pair BnFAD2_T03
caggatccatgggtgcaggtggaagaatgcaagtctctcctcactccagctcccccgaaaccaaaaccctcaaacgcgtcccctgcgagacaccacccttcactctctgggtggccatcgccagcaatggcggtggcaagcaggcgctggagacggtccagcggctgttgccggtgcggagacctcaagaaagcaatcccacctcactgcttccaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 45057 - DNA, 334 bp, Artificial
  Mutation in BnaC.FAD2.b introduced by TALE nuclease pair BnFAD2_T03
caggatccatggtgcaggtggaagaatgcaagtctctcctccctccagctcccccggaaccaacaccctcaaacgcgtcccctgcgagacaccaccattcactcttacctcaagatagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45058 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgggaagacctcaagaaagcaatcccacctcactgcttcaaacgctccatcccacgctccttctcctcttcgacatcatcatctcctcctcggctcctccctctaccacctctccacagcctacttccctctcccttacctcgcctaacccctctactgggcctgccaaggctgcgtcctaacgggcctctgggtcatagcccacgagtgcggccaccacgccttcagcgactac

SEQ ID NO: 45059 - DNA, 322 bp, Artificial
  Mutation in BnaC.FAD2.b introduced by TALE nuclease pair BnFAD2_T03
caggatccatgggtgcagctggaagaatgcaagtctctcctccctccagctcccccggaaccaacaccctcaaacgcgtcccctgcgagcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45060 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacaccatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45061 - DNA, 413 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccataccggccaccacctgctggggggtcaagccgtgggcctggcacagcaccggcaacagccgctggaccggagacctcaagaaagcaatcccacctcactgcttcaaacgctccatccctcgctccttctcctacctcctcttcgacatcctcgtctcctcctccctctaccccctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45062 - DNA, 279 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 45063 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcggccgaacgggcctctgggttatagcccacgagtgcggccaccacgccttcagcgactac

SEQ ID NO: 45064 - DNA, 331 bp, Artificial
  Mutation in BnaC.FAD2.b introduced by TALE nuclease pair BnFAD2_T03
caggatccatgggtgcaggtggaagaatgcaagtctctcctccctccagctaccccgaaaccaacaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45065 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctcctgggcctgccaaggctgcgtcctaacggtcctctgggtcatagcccacgagtgcggccaccacgccttcagcgactac

SEQ ID NO: 45066 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgccatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45067 - DNA, 305 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45068 - DNA, 336 bp, Artificial
  Mutation in BnaC.FAD2.b introduced by TALE nuclease pair BnFAD2_T03
caggatccatgggtgcaggaggaagaatgcaagtctctaatccctcaagctcccccggaaccaacaccctcaaacgcgtcccctgcgagacaccaccattcactccagacctcaagaaagcaatcccacctcactgcttcaaacgctccagcccacgctccttagcctcatcgacatcatcatcacctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45069 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 45070 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgggtcaagccgtgggcctggcacagcaccggcaagcaggcgctgcagagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 45071 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagaccccaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45072 - DNA, 334 bp, Artificial
  Mutation in BnaC.FAD2.b introduced by TALE nuclease pair BnFAD2_T03
caggatccatgggtgcagggggaagaatgcaagtctctcgtccctcaagctcccccggaaccaacaccctaaaacgcgtccccagcgagacaccaccatacactcagacatcaagaaagcaatcccacctcactgctccaaacgctacatccctcgctccttctcctacctcctcttcgacatcctcgtctcctcctccctctaccacctctccacagcctacttccctctcccttacctcgcctgacccctctactggtccggccaatgctgcgtcctaacgtgcctctgagtcatagcccacgagtgctgccaccacgccttcatcgactac

SEQ ID NO: 45073 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgtggccaccacgccttcagcgactac

SEQ ID NO: 45074 - DNA, 336 bp, Artificial
  Mutation in BnaC.FAD2.b introduced by TALE nuclease pair BnFAD2_T03
caggatccatgggtgcaggcggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45075 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaataccctcaaacgcaatcccacctcactgcttcaaacgctccatccctcgctccttctcctacctcctcttcgacatcctcgtctcctcctccctctaccacccctccacagcctactcccctctcctcccccaccctctcccttacctcgcctggcccctctactgggcctgccaagggtgcgtcctaacgggcctctgggtcatagcccacgagtgcggccaccacgccttcagcgactac

SEQ ID NO: 45076 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45077 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 45078 - DNA, 324 bp, Artificial
  Mutation in BnaC.FAD2.b introduced by TALE nuclease pair BnFAD2_T03
caggatcaatgggtgcaggtggaagaatgcaagtctctcctccctccagctcccccggaaccaacaccctcaaacgcgtcccctgcgagacaccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctctgggtcatagcccacgagtgcggccaccacgccttcagcgactac

SEQ ID NO: 45079 - DNA, 313 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctcaccctctctcctacttcgcctggcctctctactgggcctgccagggctgcgtcctaaccggcgtctgggtcatagcccacgagtgcggccaccacgccgtcagcgactac

SEQ ID NO: 45080 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagccaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgcgcctggcccctctactgggcctgccaagggtgcgtcctaaccggcgtctgggtcatagcccacgagtgcggcctccacgcctgcagcgactac

SEQ ID NO: 45081 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaacccaaaaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccagcacgccttcagcgactac

SEQ ID NO: 45082 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaacactcaaacgcgtcccctgcgagacaccacccttcactctcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45083 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 45084 - DNA, 317 bp, Artificial
  Mutation in BnaC.FAD2.b introduced by TALE nuclease pair BnFAD2_T03
caggatccatgggtgcaggtggaagaatgcaagtgtctcctccctcaagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaatggtgcgtcctaacgggcctctgggtcatcgcccacgaatgcggccaccacgccttcagcgactac

SEQ ID NO: 45085 - DNA, 334 bp, Artificial
  Mutation in BnaC.FAD2.b introduced by TALE nuclease pair BnFAD2_T03
caggatccatgggtgcaggtggaagaatgcaagtctctcctcactacagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45086 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgcgcctggcccctctactgggcctgccaaggctgcgtcctaacgggcctctgggtcatcgcccacgaatgcggccaccacgccttcagcgactac

SEQ ID NO: 45087 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 45088 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccctacctcgcctgacccctctactgggcctgccaaggctgcgtcctaacgggcctctgggtcatagcccacgagtgcggccaccacgccttcagcgactac

SEQ ID NO: 45089 - DNA, 377 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaatggcggtggcaagcaggcgctggagagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45090 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45091 - DNA, 417 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgtccggccacttcaagggcaactacaaggcccagctgaccaggctgaaccacatcaccaactgcggagaactcaagaaagcaatcccacctcactgcttcaaacgctccatccctcgctccttctcctacctcctcttcgacatcctcgtctccgcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45092 - DNA, 457 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcatcatataatttctgttgaattacgttaagcatgtaataattgatggccagcaatattggtggcaagcaggcgctggagacggtgcaggcgctgttgccggtgctgtgccaggcccacggcttgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45093 - DNA, 334 bp, Artificial
  Mutation in BnaC.FAD2.b introduced by TALE nuclease pair BnFAD2_T03
caggatccatgggtgcaggcggaagaatgcaagtctctcctccctccagctcccccgaaaccaaaaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45094 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcttggtcatagcccacgagtgcggctaccacgccttcagcgactac

SEQ ID NO: 45095 - DNA, 336 bp, Artificial
  Mutation in BnaC.FAD2.b introduced by TALE nuclease pair BnFAD2_T03
caggatccatgggtgcaggtgggagaatgcaagtgtctcctccctccagctcccccggaaccaacaccctcaaacgcgtcccctgcgagacaccaccattcactaaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45096 - DNA, 322 bp, Artificial
  Mutation in BnaC.FAD2.b introduced by TALE nuclease pair BnFAD2_T03
caggatccatgggtgcaggtggaagaatgcaagtctctcctcaatccagctcccccggaaccaacaccctcaaaacgcgtcccctgttatcgagacctcaagaaagcaatcccacctcactgcctcaaacgctccatcccacgctccttctcctcttcgacatcatcatctcctcctcggctcctccctctaccacctctccacagcctacttccctctcccttacctcgcctggcccctctacttggcctgccaaggctgcgtcctaacgggcctctgggtcaccgcccacgaatgcggccaccacgccttcagcgactac

SEQ ID NO: 45097 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45098 - DNA, 348 bp, Artificial
  Mutation in BnaC.FAD2.b introduced by TALE nuclease pair BnFAD2_T03
caggatccatgggtgcaggaggaagaatgcaagtctctcctccctccagctccccctaaaccaaaaccctcaaacgcgtcccctgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45099 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 45100 - DNA, 350 bp, Artificial
  Mutation in BnaC.FAD2.b introduced by TALE nuclease pair BnFAD2_T03
caggatccatgggtgcaggtgaaagaatgcaagtctctactccatcaagctcccccggaaccaacacccaccaacgcgtcccctgcgagccaccaccattcactcagacctcaagaaagcaatcccacctcactgcttcaaacgctccatcccacgctccttctcctcttcgacatcatcatctcctcctcggctcctccctctaccacctctccacagcctacttccctctcctccctcaccctctctcctgcttcgcctggcctctctactgggccggccaagggtgcgtcctaaccggcgtctgggtcatagcccacgattgcggccaggacggcttcagcgactac

SEQ ID NO: 45101 - DNA, 336 bp, Artificial
  Mutation in BnaC.FAD2.b introduced by TALE nuclease pair BnFAD2_T03
caggatccatgggtgcaggtggaagaatgcaagtctctccttcctccagctcccccggaaccaacaccctcaaccgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggccggccaaggctgcgtcctaacgtgcctctgggtcagagcccacgagggcggccaccacgccttcagcgactac

SEQ ID NO: 45102 - DNA, 335 bp, Artificial
  Mutation in BnaC.FAD2.b introduced by TALE nuclease pair BnFAD2_T03
caggatccatgggtgcaggtgcaagaatgcaagtctctcctccctccagctcccccgaaaccaaaaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45103 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtaccctgcgagacaccgcccttcaagaactcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45104 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaacccaaaaccctcaaacgcgtcccctgcgagacaccacccttcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45105 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactaacctcaagaaagcaatcccacctcactgcttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcataacgggcctctgggtcatcgcccacgaatgcggccaccacgccttcagcgactac

SEQ ID NO: 45106 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagaacctcaagaaagcaatcccacctcactgcttcaaacgctccatcccacgctccttctcctcttcgacatcatcatctcctcctcggctcctccctctaccacctctccacagcctacttccctctcccttacctcgcctgacccccccactgggcccgccaaggctgcgtcctaacgggcctctgggtcatagcccacgagtgcggccaccacgccttcagcgactac

SEQ ID NO: 45107 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccccctcctcccccaccctctcccttacctcgcctggcccctctactgggcctgccaaggctgcgtcctaacgggcctctgggtcatcgcccacgaatgcggccaccacgccttcagcgactac

SEQ ID NO: 45108 - DNA, 396 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccaaaaccctcaaacgcgtcccctgcgagacaccacccttcactcgggtcaagccgtgggcctggcacagcaccggcaagcaggcgctggagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45109 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgggacaccaccattcactctagacctcaagaaagcaatcccacctcactgcttcaaacgctccatcccacgctccttctcctcttcgccatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45110 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagttgccggtgctgtgccaggcccacggcttgaccccccagcaggtggtggccatcgccagcagacctcaagaaagcaatcccacctcactgcttcaaacgctccatcccacgctccttctcctcttcgacatcatcatctcctcctcggctcctccctctcccacctccccacagcctacttccctctcccttacctcgcctgacccctctactgggcctgccaaggctgcgtcctaacgggcctctgggtcatagcccacgagtgcggccaccacgccttcagcgactac

SEQ ID NO: 45111 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacatctccacagcctacttccctctcccttacctcgcctgacccctctactgggcctgccaaggctgcgtcctaacgggcctctgggtcatagcccacgagtgcggccaccacgccttcagcgactac

SEQ ID NO: 45112 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgggaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctctgggtcatagcccacgagggcggccaccacgccttcagcgactac

SEQ ID NO: 45113 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcaccgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45114 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaacgctgcgtcctaacgggcctctgggtcatcgcccacgaatgcggccaccacgccttcagcgactac

SEQ ID NO: 45115 - DNA, 311 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatcaaacgctccatcccacgctccttctcctcttcgacatcatcatctcctcctcggctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 45116 - DNA, 386 bp, Artificial
  Mutation in BnaC.FAD2.b introduced by TALE nuclease pair BnFAD2_T03
caggatccatgggtgcaggtggaagaatgcaagtctctcctcactacagctcccccggaaccaacaccctcaaacgcgtcccctgcggcctttttacggttcctggccttttgctggccttttgctcacatgttctttcctgcgttatcccccgggagacctcaagaaagcaatcccacctcactgcttcaaacgctccatcccacgctccttctcctcttcgacatcatcatctcctcctcggctcctccctctcccacctctccacagcctacttccctcgcccttacctcgcctggcccctctactgggcctgccaaggctgcgtcctaacgggcctctgggtcatagcccacgagtgcggccaccacgccttcagcgactac

SEQ ID NO: 45117 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45118 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgaacctcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45119 - DNA, 348 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45120 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45121 - DNA, 406 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaagcgcctgcttgccaccattattgctcacgatggccaccacctgctggggggtcaagttgagcggggcacccgtcagtgcattgcgccagcgacctcaagaaagcaatcccacctcactgcttcaaacgccccacccctcgctccttctcctacctcctcttcgacatcctcgactcctcctccctcgaccgccactccacagcctacttccctcacctcccccgccctctcccttacctcgcctggcccctctactgggcctgccaaggctgcgtcctaacgggcctctgggtcagcgcccacgaatgcggccaccacgccttcagcgactac

SEQ ID NO: 45122 - DNA, 333 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcactagacctcaagaaagcaatcccaccgcactgtttcaaacgctcgatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 45123 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacccctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45124 - DNA, 350 bp, Artificial
  Mutation in BnaC.FAD2.b introduced by TALE nuclease pair BnFAD2_T03
caggatccatgggtgcaggtgaaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 45125 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaacgggcctctgggtcatcgcccacgaatgcggccaccacgccttcagcgactac

SEQ ID NO: 45126 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45127 - DNA, 328 bp, Artificial
  Mutation in BnaC.FAD2.b introduced by TALE nuclease pair BnFAD2_T03
caggatccatgggtgcaggcgcaagaatgcaagtctctcctcactacagctcccccgaacccaaaaccctaaaacgcgtcccctgcgagacaccacccttcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45128 - DNA, 349 bp, Artificial
  Mutation in BnaC.FAD2.b introduced by TALE nuclease pair BnFAD2_T03
caggatccatgggtgcaggtggaagaatgcaagtctctcctcccttcagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcacgactac

SEQ ID NO: 45129 - DNA, 351 bp, Artificial
  Mutation in BnaC.FAD2.b introduced by TALE nuclease pair BnFAD2_T03
caggatccatgggtgcaggtgtaagaatgcaagtctctcctccctccagctcccccggaaccaacaccctcaaccgcgtcccctgcgagacaccaccattcactccagacctcaagaaagcaatcccacctcactgcttcaaaccctccaccccacgctccttctcctcttcgacgtcatcatctcctcctcggctcctccctctaccacctctccacagcctacttccctctcctcccccaccctctcccttacctcgcctggcccctctactgggtctgccaaggctgcgtcctaacgggcctctgggtcagcgcccacgaaggctgccaccacgccttcagcgactac

SEQ ID NO: 45130 - DNA, 373 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacacgtcccctgcgagacaccaccattcactctgcgttatcccctgattctgtggataaccgtattaccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45131 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45132 - DNA, 365 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgtagcggtggtttttttgccggatcaagagctaccaactctttttccgaaggtaactggcttcagcaatcccacctcactgcttcaaacgctccatcccacgctccttctcctcttcgacatcatcatctcctcctcggctcctccctcaccctctctcctccttcgcctggcctctctactgggcctgccaagggtgcgtcctaacgggcctctgggtcatagcccacgagtgcggccaccacgccttcagcgactac

SEQ ID NO: 45133 - DNA, 336 bp, Artificial
  Mutation in BnaC.FAD2.b introduced by TALE nuclease pair BnFAD2_T03
caggatccatgggtgcaggtggatgaatgcaagtctctcctccctccagctcccccgaaaccaaaaccctcaaacgcgtcccctgcgagacaccacccttcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45134 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatcgcccacgaaggcggccaccacgccttcagcgactac

SEQ ID NO: 45135 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 45136 - DNA, 343 bp, Artificial
  Mutation in BnaC.FAD2.b introduced by TALE nuclease pair BnFAD2_T03
caggatccatgggtgcaggtggaagaatgcaagtctctcatccctccagctcccccggaaccaaaaccctcaaacgcgtcccctgcgagacaccacccttcactctagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45137 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgcttcaaacgctccatccctcgctccttctcctacatcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45138 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgccccctctactgggcctgccaaggcggcgtcctaacgggcctctggttcatcccccacgaatgcggccaccacgcctccagcgactac

SEQ ID NO: 45139 - DNA, 349 bp, Artificial
  Mutation in BnaC.FAD2.b introduced by TALE nuclease pair BnFAD2_T03
caggatccatgggtgcaggtggaagaatgcaagtctctacttccttcagctcccccgaaaccaaaatcctcaaacgcgtcccctgcgagataccacccttcactcagacctcaagaaagcaatcccacctaactgcttcaaacgctccatccctcgctccttctcctacctcctcttcgacatcctcgtctcctcctccctctaccacctctccacatcctacttctctctcctcccccaccctctcccttaccgcgcctggcccctctactgggcctgccaaggctgcgtcctaacgggcctctgggtcatcgcccacgaatgcggccaccacgccttcagcgactac

SEQ ID NO: 45140 - DNA, 399 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttgggggatcctatcagccgttcccagctggtgaagtccgagctggaggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45141 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcatac

SEQ ID NO: 45142 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctcgaccacctctccacagcctacttccctctcccttacctcgcctggcccctctactgggcctgccaagggtgcgtcctaacgggcctctgggtcatagcccacgagtgcggccaccacgccttcagcgactac

SEQ ID NO: 45143 - DNA, 339 bp, Artificial
  Mutation in BnaC.FAD2.b introduced by TALE nuclease pair BnFAD2_T03
caggatccatgggtgcaggtggaagaattcaagtctctcctccctccagctcccccgaaaccaaaaccctcaaacgcgtcccctgcgagacaccacccttcactctcgggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45144 - DNA, 430 bp, Artificial
  Mutation in BnaC.FAD2.b introduced by TALE nuclease pair BnFAD2_T03
caggatccatgggtgcaggtggaagaatgcaagtctctcctcactccagctcccccggacccaacaccctcaaacgcgtcccctgcgagacaccaccattcactctagcgcctgctgccggtgctgtgccaggcccacggcttgaccccccagcaggtggtggccatcgccagcaataatggtggcagacctcaagaaagcaatcccacctcactgcttcaaacgctccatccctcgctccttctcctacctcccctccgacacccccgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45145 - DNA, 279 bp, Artificial
  Mutation in BnaC.FAD2.b introduced by TALE nuclease pair BnFAD2_T03
caggatccatgggtgcaggtggaagaatgcaagtctcacctcactccagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45146 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaccctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45147 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccataaaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45148 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45149 - DNA, 351 bp, Artificial
  Mutation in BnaC.FAD2.b introduced by TALE nuclease pair BnFAD2_T03
caggatccatgggtgcaggtggaagaatgcaagtgtctcctccctcaaaaaagtctgaaaccgacaacatcaagcgcgtaccctgcgagacaccgcccttcactgtcagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45150 - DNA, 418 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctctccagcggctgttgccggtgctgtgccaggcccacggcttgaccccccagcaggtggtggccatcgccagcaataatggggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctagcgggcctctgggtcatcgcccacgaatgcggccaccacgccttcagcgactac

SEQ ID NO: 45151 - DNA, 347 bp, Artificial
  Mutation in BnaC.FAD2.b introduced by TALE nuclease pair BnFAD2_T03
caggatccatgggtgcaggtggaagaatgcaagtctctcctccctccagctaccccggaaccaacaccatcaaacgcgtcccctgcgagacaccacccttcactaacctcaagaacgcaatcccaccgcactgcttcaaacgctccatccctcgctccttctcctacctccacttcgacatcctcgtcgcctcctccctctacttcctcgccacagcctacttccctctcctcccccaccctctcccttacctcgcctggcccctctactgggcctgccaaggctgcgtcctaacgggcctctgggtcatagcccacgaatgcggccaccacgccttcagcgactac

SEQ ID NO: 45152 - DNA, 332 bp, Artificial
  Mutation in BnaC.FAD2.b introduced by TALE nuclease pair BnFAD2_T03
caggatccatgggtgcaggtgaaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 45153 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 45154 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 45155 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacaagaaagcaatcccacctcactgcttcaaacgctccatcccacgctccttctcctacctcctcttcgacatcatcatctcctcctcggctcctccctctaccacctctccacagcctacttccctctcccttacctcgtctgacccctctactgggcctgccaaggctgcgtcctaacgggcctctgggtcatagcccacgagtgcggccaccacgccttcagcgactac

SEQ ID NO: 45156 - DNA, 349 bp, Artificial
  Mutation in BnaC.FAD2.b introduced by TALE nuclease pair BnFAD2_T03
caggatccatgagtgcaggtggaagaatgcaagtctctcctccctccagctcccccgaaaccaaaaccctcaaccgcgtcccctgcgagaccccacccttcactctcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggcggcgtcctaacgggcctctgggtcatcgcccacgaatgcggccaccacgccttcagcgactac

SEQ ID NO: 45157 - DNA, 334 bp, Artificial
  Mutation in BnaC.FAD2.b introduced by TALE nuclease pair BnFAD2_T03
caggatccatgggtgcaggtggaagaatgcaagtctctcatacctccagctcccccggaaccaacaccctaaaacgcgtcccctgcgagacaccaccattcactcgacctcaagaaagcaatcccacctcactgcttcaaacgctccatcccactctccttctcctcttcgacatcatcatctcctcctcggcgcctccctctaccacctctccacagcctacttccctctcccttacctcgcctgacccctctactgggccggccaaggctgcgtcctaacgggcctctgggtcatagcccacgagtgcttccaccacgccttcagcgactac

SEQ ID NO: 45158 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcttcaagaaagcaatcccacctcactgcttcaaacgctccatccctcgctccttctcctccctcctcctcgacatcctcctctcctcctccctctaccacctctccacagcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 45159 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgtcaagggtgcgtcctaaccggcgtctgggtcatagcccacgagtgcggccaccacgccttcagcgactac

SEQ ID NO: 45160 - DNA, 397 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctctccagcgcctgcttgccaccattattgctggcgatggccaccacctgctggggggagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactacctgac

SEQ ID NO: 45161 - DNA, 348 bp, Artificial
  Mutation in BnaC.FAD2.b introduced by TALE nuclease pair BnFAD2_T03
caggatccatgggtgcaggtgaaagaatgcaagtctctcctccctccagcccccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45162 - DNA, 285 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45163 - DNA, 348 bp, Artificial
  Mutation in BnaC.FAD2.b introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45164 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccacctcactgcttcaaacgctccatccctcgctcctcctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45165 - DNA, 342 bp, Artificial
  Mutation in BnaC.FAD2.b introduced by TALE nuclease pair BnFAD2_T03
caggatccatgggtgcaggtggaagaatgcaagtctctcctcccttcagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctccctctaccacctctccacagcctacttccctctcctcccccgccctctcccttacctcgcctggcccctcgacggggcctgccaaggctgcgtcctaacgggcctctgggtcatcgcccacgaatgcggccaccacgccttcagcgactac

SEQ ID NO: 45166 - DNA, 350 bp, Artificial
  Mutation in BnaC.FAD2.b introduced by TALE nuclease pair BnFAD2_T03
caggatccatgggtgcaggcggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgcaaaggctgcgtcctaacgggcctctgggtcagcgcccacgaatgcgtccaccacgcctgcagcgactac

SEQ ID NO: 45167 - DNA, 400 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcaccggcaacagccgctggaccgtctccagcgcctgcttgccaccagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45168 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctctgggtcatagcccacgagtgcggccaccacgccttcagcgactac

SEQ ID NO: 45169 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 45170 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45171 - DNA, 335 bp, Artificial
  Mutation in BnaC.FAD2.b introduced by TALE nuclease pair BnFAD2_T03
caggatccatgggtgcaggtggaagaatgcaagtgtctcatccctgcaagaagtctgaacccgacaccatcaagcgcgtaccctgcgagacaccaccattcactctgacctcaagaaagcaatcccacctcactgcttcaaacgctccatcccacgctccttctcctcttcgacatcatcatctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 45172 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 45173 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccagagacctcaagaaagcaatcccacctcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45174 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccctgacctcaagaaagcaatcccacctcactgcttcaaacgctccttccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45175 - DNA, 416 bp, Artificial
  Mutation in BnaC.FAD2.b introduced by TALE nuclease pair BnFAD2_T03
caggatccatgggtgcaggtgaaagaatgcaagtctctactctctcaagctcccccggaaccaacacccccaaacgcgtccccagcgagacaccaccattcactctagcgcctgctgccggtgctgtgccaggcccacggcttgaccccccagccggcggtggccatcgccagcaataatggtggcagacctcaagaaagcaatcccacctcactgcttcaaacgctccatcccacgctccttctcctcttcgacaacatcatctcctcctcggctcctccctcttccacctctccacagcctacttccctctcccttaccgcgcctggcccctctactgggcctgccaaggcttcggccgaacgtgcctctgggtcatatcccacgagtgcggccaccacgccttcagcgactac

SEQ ID NO: 45176 - DNA, 350 bp, Artificial
  Mutation in BnaC.FAD2.b introduced by TALE nuclease pair BnFAD2_T03
caggatccatgggtgcaggtggaagaatgcaagtctctcctccctcaagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45177 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcggcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45178 - DNA, 332 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagaccccacccttcactacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45179 - DNA, 323 bp, Artificial
  Mutation in BnaC.FAD2.b introduced by TALE nuclease pair BnFAD2_T03
caggatccatgggtgcaggtggaagaatgcaagtgtctcctccctccagctcccccgaaacaaaaaccctcaaacgcgtcccctgcgagaaagcaatcccacctcactgcttcaaacgctccatccctcgctccttctcctacctcctcttcgacatcctcgtctcctcctccctctaccacctctccacagcctacttccctctcctcccccaccatctcccttacctcgcctggcccctctactgggcctgccaaggctgcgtcctaacgggcctctgggtcatcgcccacgaatgcggccaccacgccttcagcgactac

SEQ ID NO: 45180 - DNA, 333 bp, Artificial
  Mutation in BnaC.FAD2.b introduced by TALE nuclease pair BnFAD2_T03
caggatccatgggtgcaggtggaagaatgcaagtctctcctccctacagctcccccgaaaccaaaaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45181 - DNA, 342 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45182 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcacagacctcaagaaagcaatcccacctcactgcttcaaacgctccatcccacgctccttctcctcttcgacatcatcatctcctcctcggctcctccctctaccacctctccacagcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 45183 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccctctactggtcctgccaaggctgcgtcctaacgggcctctgggtcatcgcccacgaatgcggccaccacgccttcagcgactac

SEQ ID NO: 45184 - DNA, 266 bp, Artificial
  Mutation in BnaC.FAD2.b introduced by TALE nuclease pair BnFAD2_T03
caggatccatgggtgcaggtggaagaatgcaagtctcgacctccaccaagcaatcccacatcacggctttcaacgctccatcctacgctccttctccttttcttcatcaccatctcctcctcggctcctccctctaccacctctccccagcctactcccctctcccttacctcgcctggcccctctactgggcctgccaaggctgcgtcctaacgggcctctgggtcatagcccacgagtgcggccaccacgccttcagcgactac

SEQ ID NO: 45185 - DNA, 339 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagcgagacctcaagaaagcaatcccacctcactgcttcaaacgctccatcccacgctccttctcctcttcgacatcatcatctcctcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45186 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagcctacttccctctcctcccccaccctctcccttaccgcgcctggcccctctactgggcctgccaaggctgcgtcctaacgggcctctgggtcatcgcccacgaatgcggccaccacgccttcagcgactac

SEQ ID NO: 45187 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaccgcgtcccctgcgagacaccacccttcactctgtcaagaaagcaatcccacctcactgcttcaaacgctccatccctcgctccttctcctcttcgacatcatcatctcctcctcggctcctccctctaccacctctccacagcctacttccctctcccttacttcgcctggcctctctactgggcctgccaagggtgcgtcctaaccggcgtctgggtcatagcccacgagtgctgccaccacgccttcagcgactac

SEQ ID NO: 45188 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45189 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45190 - DNA, 306 bp, Artificial
  Mutation in BnaC.FAD2.b introduced by TALE nuclease pair BnFAD2_T03
caggatccatgggtgcaggtggaagaatgcaagtatctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45191 - DNA, 349 bp, Artificial
  Mutation in BnaC.FAD2.b introduced by TALE nuclease pair BnFAD2_T03
caggatccatgggtgcaggtggaagaatgcaagtctctcctcccttcagctcccccgaaaccaaaaccctcaaacgcgtcccctgcgagacaccacccctcactctgacctcaagaaagcaatcccacctcactgcttcaaacgctccatccctcgctccttctcctacctcctcttcgacatcctcgtctcctcctccctctaccacccctccacagcctacttccctctcctcccccaccctctcccttccctcgcctggcccctctactgggcctgccaaggctgcgtcctaacgggcctctgggtcatcgcccacgaatgcggcctgcacgccttcagcgactac

SEQ ID NO: 45192 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttaagaaagcaatcccacctcactgcttcaaacgctccatccctcgctccttctcctacctcctcttcgtcatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45193 - DNA, 339 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45194 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgtctggcctctctactgggcctgccaagggtgcgtcctaaccggcgtctgggtcatagcccacgagtgcggccaccacgccttcagcgactac

SEQ ID NO: 45195 - DNA, 363 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgcgatggcggcaagcaggcgctggagaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45196 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 45197 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45198 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 45199 - DNA, 300 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 45200 - DNA, 336 bp, Artificial
  Mutation in BnaC.FAD2.b introduced by TALE nuclease pair BnFAD2_T03
caggatccatgggtgcaggggaaagaatgcaagtctctcctccctgcagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctccgctcctccctctaccacctctccacagcctacttccctctcccttacctcgcctcacccctctactgggcttgccaaggctgcgtcctaacgggcctctgggtcatagcccacgagtgcggccaccacgccttcagcgaccac

SEQ ID NO: 45201 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 45202 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcagagcccacgagtgcggccaccacgccttcagcgactac

SEQ ID NO: 45203 - DNA, 413 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcgggatgggatccgatccaatgaagacaatcgacatagtgactggatatgttgtgttttacagagaactcaagaaagcaatcccaccgcactgtttcaaacgctcgatccctcgctctttctcctacctcctcttcgacatcctcgtctccgcctccctctaccccctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45204 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 45205 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 45206 - DNA, 331 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45207 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatccctcgctccttctcctaactcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45208 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggacccaacaccctcaaacgcgtcccctgcgagacaccacccttcactctgacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 45209 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgttccctgcgagacaccaccattcactaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccccctactgggcctgccaaggctgcgtcctaacgggcctctgggtcatagcccacgagtgcggccaccacgcctttcagcgactac

SEQ ID NO: 45210 - DNA, 278 bp, Artificial
  Mutation in BnaC.FAD2.b introduced by TALE nuclease pair BnFAD2_T03
caggatccatgggtgcaggtggaagaatgcaagtctctcatccctccagctcccccgaaaccaaaaccctcaaacgcgtcccctgcgagacaccacccttcactctcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45211 - DNA, 348 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45212 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagggcggccaccacgccttcagcgactac

SEQ ID NO: 45213 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 45214 - DNA, 386 bp, Artificial
  Mutation in BnaC.FAD2.b introduced by TALE nuclease pair BnFAD2_T03
caggatccatgggtgcaggtgcaagaatgcaagtctctcctccctccagctcccccggaaccaacaccctcaaacgcgtcccctgcgagacaccaccattcactcttccaggcccacggcttgaccccccagcaggtggtggccatcgccagcactggacctcaagcaagcaatcccacctcactgcttcaaacgctccatcccacgctccttctcctcttcgacatcatcatctcctcctcggctcctccctctgccacctctccacagcctacttccctctcccttacctcgcctgacccctctactgggcctgccatggctgcgtccgaacgggcctctgggtcttagcccacgagtgcgtcctccacgccttcagcgactac

SEQ ID NO: 45215 - DNA, 400 bp, Artificial
  Mutation in BnaC.FAD2.b introduced by TALE nuclease pair BnFAD2_T03
caggatccatgggtgcaggtggaagaatgcaagtctctcctcactccagctcccccggaaccaacaccctcaaacgcgtcccctgcgagacaccaccattcactctcaggcgctggagacggtccagcggctgttgccggtgctgtgccaggcccacggcttgaccccggagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaatgctgcgtcctaacgggcctctgggtcagagcccacgagtgcggccaccacgccgtcagcgactac

SEQ ID NO: 45216 - DNA, 331 bp, Artificial
  Mutation in BnaC.FAD2.b introduced by TALE nuclease pair BnFAD2_T03
caggatccatgggtgcaggtggaagaatgcaagtctctcctccctcaagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgcgcctggcccctctactgggcctgccaaggctgcgtcctaacgggcctctgggtcatcgcccacgaatgcggccaccacgccttcagcgactac

SEQ ID NO: 45217 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaacaaaaaccctcaaacgcgtcccctgcgagacaccacccttcactctcgacctcaagaaagcaatcccacctcactgcttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 45218 - DNA, 335 bp, Artificial
  Mutation in BnaC.FAD2.b introduced by TALE nuclease pair BnFAD2_T03
caggatccatgggtgcaggtggaagaatgcaagtctctcctccctcaagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45219 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactaagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45220 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45221 - DNA, 441 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggggagaaaggcggacaggtatccggtaagcggcagggtcggaacagccgctggaccgtctccagcgcctgcttgccaccattattgctggccctcaagaaagcaatcccacctcactgcttcaaacgctccatcccacgctccttcccctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45222 - DNA, 348 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacacccacaaacgcgtcccctgcgagacaccaccattcactcaacctcaagaaagcaatcccacctcactgcttcaaacgctccatcccacgctccttctcctcttcgacatcatcatctcctcctcggctcctccctctaccacctctccacagcctacttccctctcctcccccaccctctcccttaccgcccctggcccctctactgggcccgccaaggctgcgtccgaacgggcctctgtgtcatcgcccacgaatgctgccaccacgccttcatcgctac

SEQ ID NO: 45223 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctccccccccctctccctttcctcgcctggcccctctactgggcctgccatggctgcggcctaacgggcctctgggtcatagcccacgagtgcggccaccacgccttcagcgactac

SEQ ID NO: 45224 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctagcaggcgctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgctgccaccacgccttcagcgactac

SEQ ID NO: 45225 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45226 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctccatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 45227 - DNA, 332 bp, Artificial
  Mutation in BnaC.FAD2.b introduced by TALE nuclease pair BnFAD2_T03
caggatccatgggtgcaggtggaagagtgcaagtctctcctccctccagctcccccggaaccaacaccctcaaacgcgtcccctgcgagacaccaccattcactacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45228 - DNA, 334 bp, Artificial
  Mutation in BnaC.FAD2.b introduced by TALE nuclease pair BnFAD2_T03
caggatccatgggtgcaggtggaagaatgcaagtctctactccctccagctcccccggaaccaacacactcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 45229 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcggagacctcaagaaagcaatcccacctcactgcttcaaacgctccatccctcgctccttctcctacctcctcttcgacatcctcgtctcctcctccctctaccacccctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45230 - DNA, 406 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccagcgcctgcttgccaccattattgctggcgatggccaccacctgctggggggtcaagttgagcggggcacccgtcagtgcattgcgccagagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45231 - DNA, 317 bp, Artificial
  Mutation in BnaC.FAD2.b introduced by TALE nuclease pair BnFAD2_T03
caggatccatgggtgcaggtgcaagaatgcaagtctctcctcactccagctcccccgaacccaaaaccctcaaacgcgtcccctgcgagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45232 - DNA, 265 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatcccacgctccttctcctcttcgacatcatcatctcctcctcggctcctccctctaccacctctccacagcctacttccctctcccttacctcgcccgacccctctactgggcctgccaaggctgcgtcctaacgggcctctgggtcatagcccacgagtgcggccaccacgccttcagcgactac

SEQ ID NO: 45233 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcttggtcatagcccacgagtgcggccaccacgccttcagcgactac

SEQ ID NO: 45234 - DNA, 349 bp, Artificial
  Mutation in BnaC.FAD2.b introduced by TALE nuclease pair BnFAD2_T03
caggatccatgggtgcaggtggaagaatgctagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 45235 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 45236 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctccctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgcgcctggcccctctactgggcctgccaaggctgcgtcctaacgggcctctgggtcatcgcccacgaatgcggccaccacgccttcagcgactac

SEQ ID NO: 45237 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactcagacctcaagaaaacaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45238 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcctcaagaaagcaatcccaccgcactgtttcaaacgctcgatccctcgctctttctcctacctcatcttggacatcatcatatcctcctgcttctactactccgccaccacttacttccctctcctcccccaccctctcccctacttcgcctggcccctctactgggcctgccaaggctgcgtcctaacgggcctctgggtcatcgcccacgaatgcggccaccacgccttcagcgactac

SEQ ID NO: 45239 - DNA, 306 bp, Artificial
  Mutation in BnaC.FAD2.b introduced by TALE nuclease pair BnFAD2_T03
caggatccatgggtgcaggtggaagaatgcaagtctctagtttcttcagctcccccgaaaccaaaaccctcaaacgcaatcccacctcactgcttcaaacgctccatccctcgctccttctcctacctcctcttcgacatcctcgtctcctcctccctctaccacctctccacagcctacttccctctcctccccccccctctcccttacctcgcctggcccctctactgggccggccaaggctgcgtcctaacgggcctctgggtcatcgcccacgaatgcggccaccacgccatcagcaactac

SEQ ID NO: 45240 - DNA, 341 bp, Artificial
  Mutation in BnaC.FAD2.b introduced by TALE nuclease pair BnFAD2_T03
caggatccatgggtgcaggtggaagaatgcaagtctctcctcctccagctcccccgaaaccaaaaccctcaaacgcgtcccctgcgagacaccacccttcactctcggcctttttacggttcctctccctcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 45241 - DNA, 399 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttgggggatcctatcagccgttcccagctggtgaagtccgagctggaggagaactcaagaaagcaatcccaccgcactgtttcaaacgctcgatccctcgctctttctcctacctcctcttcgacatcctcgtctcctcctccctctaccacctctccacagcctacttccctctccgcccccaccctctcccttacctcgcctggcccctctactgggcctgccaaggctgcgtcctaacgggcctctgggtcatcgcccacgaatgcggccaccacgccttcagcgactac

SEQ ID NO: 45242 - DNA, 331 bp, Artificial
  Mutation in BnaC.FAD2.b introduced by TALE nuclease pair BnFAD2_T03
caggatccatgggtgcaggcggaagaatgcaagtctctcctccctccagctcccccgaaaccaaaaccctcaaacgcgtcccctgcgagacctcaagaaagcaatcccacctcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45243 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45244 - DNA, 404 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcataccctgcgagacaccgcccttcactgtctccagcgcctgcttgccgccatcgtggctggcgatggccaccacctgctccggagaactcaagaaagcaatcccacctcactgcttcaaacgctccatccctcgctccttctcctacctcctcttcgacatcctcgtctcctcctccctctcccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45245 - DNA, 347 bp, Artificial
  Mutation in BnaC.FAD2.b introduced by TALE nuclease pair BnFAD2_T03
caggatccatgggtgcaggtggaagaatgcaagtgtctcctcactccaaaaagtctgaaaccgacaacatcaagcgcgtaccctgcgagacaccgcccttcactgaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45246 - DNA, 447 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccccagcaggtggtggccatcgccagcaataatggtggcaagcaggcgctggagacggtgctgtgccaggcccacggcttgaccccccagcaggtggtggccatcgccagcaaaactcaagaaagcaatcccacctcactgcttcaaacgctccatccctcgctccttctcctacctcctctccgacatcctcgtctcctcctccctctcccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45247 - DNA, 341 bp, Artificial
  Mutation in BnaC.FAD2.b introduced by TALE nuclease pair BnFAD2_T03
caggatccatgggtgcaggtggaagaatgcaagtgtctcctccatccaaaaagtctgaaaccgacaacatcaagcgcgtaccctgcgagacaccgcccttcactgtcggggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45248 - DNA, 350 bp, Artificial
  Mutation in BnaC.FAD2.b introduced by TALE nuclease pair BnFAD2_T03
caggatccatgagtgcaggtgaaagaatgcaagtctctacttccttaagctcccccgaaaccaaaaccctcaaacgcgtcccctgcgagacaccacccttcactctcgacctcaagaaagcaatcccacctcactgcttcaaacgatccatccctcgctccttctcctacctcctcttcgacatcctcgtctcctcctccctctaccacctctccacagcctacttccctctcctccctcaccctctctcctactgcgcccggcctctctactgggcctgccagggctgcggccgaaccggcgtctggctcacagcccgcaagtgctgcctccacgccttcaccgactac

SEQ ID NO: 45249 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctagacctcaagaaagcaatcccacctcactgcttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 45250 - DNA, 335 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgagtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45251 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45252 - DNA, 348 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccacccttcactgaacctcaagaaagcaatcccaccgcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45253 - DNA, 334 bp, Artificial
  Mutation in BnaC.FAD2.b introduced by TALE nuclease pair BnFAD2_T03
caggatccatgggtgcaggtggaagaatgcaagtctctcctccatacagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagggcggccaccacgccttcagcgactac

SEQ ID NO: 45254 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctacgagacaccacccttcactcaagaaagcaatcccaactcactgcttcaaacgctccatccctcgctccttctcctaccttctcttcgccatcctcgtctcctcctccctctaccacccctccacagcctacttccctccccccccccaccctctcccttacctcgcctggcccctctactgggcctgccaaggctgcgtcctaacgggcctctgggtcatcgcccacgaatgcggccaccacgccttcagcgactac

SEQ ID NO: 45255 - DNA, 308 bp, Artificial
  Mutation in BnaC.FAD2.b introduced by TALE nuclease pair BnFAD2_T03
caggatccatgggtgcaggtgaaagaatgcaagtctcacatccctccagctcccccggaaccaagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45256 - DNA, 394 bp, Artificial
  Mutation in BnaC.FAD2.b introduced by TALE nuclease pair BnFAD2_T03
caggatccatgggtgcagctggaagaatgcaagtctctactccctacagctcccccggaaccaacaccctcaaacgcgtcccctgcgagacaccaccattcacattgaatcctgttgccggtcttgcgggactctaatcataaaaacccatctcataaataacgtagacctcaagaaagcaatcccacctcactgcttcaaacgctccatccctcgctccttctcctacctcctcttcgacatcctcgtctcctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 45257 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcaagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45258 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtcccctcctccctctaccacccctccacatcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45259 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgtggccaccacgccttcagcgactac

SEQ ID NO: 45260 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45261 - DNA, 314 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagctcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcctctgggtcatagcccacgagtgcggccaccacgccttcagcgactac

SEQ ID NO: 45262 - DNA, 332 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtactcaagaaagcaatcccaccgcactgtttcaaacgctcgatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45263 - DNA, 371 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgccggtgctgtgccaggcccagacctcaagaaagcaatcccacctcactgcttcaaacgctccatccctcgctccttctcctacctcctcttcgacatcctcgtctcctcctccctctaccacctctccacagcctacttccctctccgcccccaccctctcccttacctcgcctggcccctctactgggcctgccaaggctgcgtcctaacgggcctctgggtcatcgcccacgaatgcggccaccacgccttcagcgactac

SEQ ID NO: 45264 - DNA, 357 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcctttttacggttcctctccctcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 45265 - DNA, 344 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccaccattcactctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaactggcgtctgggtcatagcccacgagtgcggccaccacgccttcagcgactac

SEQ ID NO: 45266 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttaaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 45267 - DNA, 279 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 45268 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctccacctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45269 - DNA, 335 bp, Artificial
  Mutation in BnaC.FAD2.b introduced by TALE nuclease pair BnFAD2_T03
caggatccatgggtgcaggtggaagaatgcaagtctctcctccctccagcccccccggaaccaacaccctcaaacgcatcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45270 - DNA, 362 bp, Artificial
  Mutation in BnaC.FAD2.b introduced by TALE nuclease pair BnFAD2_T03
caggatccatgggtgcaggtggaagaatgcaagtgtctcctccctccaaaacgtctgaaaccgacaccctcaagcgcgtcccctgcgagacaccaccattcactcaatggcggctgcaagcagccgctgcagcgccctcaagaaagcactcccacctcactgcttcaaacgctccatcccacgctccttctcctcttcgacaccatcatctcctccgcggctcctccctctaccacctctccacagcctacttccctcgcccttacctcgcctgaccccgctactgggcctgccaaggcggcgtcctaacgggcctctgggtcatagcccacgagtgcggccaccacgccttcagcgactac

SEQ ID NO: 45271 - DNA, 363 bp, Artificial
  Mutation in BnaC.FAD2.b introduced by TALE nuclease pair BnFAD2_T03
caggatccatgggtgcaggtgcaagaatgcaagtctctactccctccagctcccccggaaccaacaccctcaaccgcgtcccctgcgagacaccaccattcactctgcgatggcggcaagcaggcgctggagaagacctcaagaaagcaatcccacctcactgcttcaaacgctccatcccacgctccttctcctcttcgacatcatcatctcctcctcggctcctccctctaccacctctccacagcctacttccctctcccttccctcgcctgacccctctactgggcctgccaaggctgcgtcctaacgggcctctgtgtcatagcccacgaatgcggccaccacgccttcagcgactac

SEQ ID NO: 45272 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatcccacccccctcctcctcttcgacatcatcatctcctcctcggctcctccctctaccacctctccacagcctacttccctctcctcccccaccctctcccttacctcgcctggcccctctactgggccggccaaggctgcgtcctaacgggcctctgggtcatcgcccacgaatgcggccaccacgccttcagcgactac

SEQ ID NO: 45273 - DNA, 369 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccgtccagcggctgttgccggtgttgtgcctggcggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45274 - DNA, 419 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcaacagccgctggaccgtctccagcgcctgcttgccaccattattgctggcgatggccaccacctgccatcccacgttccagacatcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaacgggcctctgggtcatcgcccacgaatgcggccaccacgccttcagcgactac

SEQ ID NO: 45275 - DNA, 320 bp, Artificial
  Mutation in BnaC.FAD2.b introduced by TALE nuclease pair BnFAD2_T03
caggatccatgggtgcaggtggaagaatgcaagtggctcctccctcgagctcccccggaaccaacaccctcaaacgcgtcccctgcgagacaccaccattcactctatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45276 - DNA, 354 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggagacctcaagaaagcaatcccaccgcactgcttcaaacgctccatccctcgctctttcccctacctcctcttcgacatcttcgtcgcctcctccctctaccacctcgccacagcttacttccctctcctcccccaccctctcccctacctcgcctggcccctctactgggcctgccaaggctgcgtcctaacgggcctctgggtcatcgcccacgaatgcggccaccacgccttcagcgactac

SEQ ID NO: 45277 - DNA, 279 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgcgagacaccacccttcactcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45278 - DNA, 343 bp, Artificial
  Mutation in BnaC.FAD2.b introduced by TALE nuclease pair BnFAD2_T03
caggatccatgggtgcaggtggaagaatgcaagtctctcctccctacagctcccccggaaccaacaccctcaaacgcgtcccctgcgagacaccaccattcactctcggtcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcgtccaccacgccttcagcgactac

SEQ ID NO: 45279 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgcgcctggcccctctactgggcctgccaaggctgcgtcctaacgggcctctgggtcatcgcccacgaatgcggccaccacgccttcagcgactac

SEQ ID NO: 45280 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagaaagcaatcccacctcactgcttcaaacgctccatccctcgctccttctcctacctcctcttcgacatcctcgtctcctcctccctctaccacctctccacagcctacttccctctcctcccccaccctcgcccttacctcgcctggcccctctactgggcctgccaaggctgcgtcctaacgggcctctgggtcatcgcccacgaatgcggccaccacgccttcagcgactac

SEQ ID NO: 45281 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcgcgactac

SEQ ID NO: 45282 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45283 - DNA, 404 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccggtccagcggctgttgccaccattattgctggcgatggccaccacctgctggggggtcaagccgtgggcagacctcaagaaagcaatcccacctcactgcttcaaacgctccatccctcgctccttctcctacctcctcttcgacatcctcgtctcctcctccctctcccacctctccacagcctacttccctctcccttacctcgcctggcccctctactgggcctgccaaggctgcgtactaacgggcctctgggtcatcgcccacgagtgcggccaccacgccttcagcgactac

SEQ ID NO: 45284 - DNA, 345 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccaccattcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45285 - DNA, 333 bp, Artificial
  Mutation in BnaC.FAD2.b introduced by TALE nuclease pair BnFAD2_T03
caggatccatgggtgcaggtggaagaatgcaagtgtctcctcactccaagaagtctgaaaccgacaccatcaagcgcgtaccctgcgagacaccacccttcactcgaccccaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45286 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacacacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 45287 - DNA, 337 bp, Artificial
  Mutation in BnaC.FAD2.b introduced by TALE nuclease pair BnFAD2_T03
caggatccatgggtgcaggtgcatgaatgcaagtgtctcctcaatccaagaagtctgaacccgacaccatcaagcgcgtaccctgcgagacaccgcccttcactgtaagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45288 - DNA, 348 bp, Artificial
  Mutation in BnaC.FAD2.b introduced by TALE nuclease pair BnFAD2_T03
caggatccatgggtgcaggcgcaagaatgcaagtctctcctcactccagctcccccgaacccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45289 - DNA, 335 bp, Artificial
  Mutation in BnaC.FAD2.b introduced by TALE nuclease pair BnFAD2_T03
caggatccatgggtgcaggtggaagaatgcaagtctctcctccatacagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 45290 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtcccctgcgagacaccacccttcactctcggcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45291 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgtccacgaatgcggccaccacgccttcagcgactac

SEQ ID NO: 45292 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccacgacgccttcagcgactac

SEQ ID NO: 45293 - DNA, 338 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccacccttcactacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtccaacgggcctctgggtcatagcccacgagtgcggccaccacgccttcagcgactac

SEQ ID NO: 45294 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctaaaacgcgtcccctgcgagacaccacccttcacggagacctcacgaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45295 - DNA, 336 bp, Artificial
  Mutation in BnaC.FAD2.b introduced by TALE nuclease pair BnFAD2_T03
caggatccatgggtgcaggtggaagaatgcaagtctctcctacctacagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgctgccaccacgccttcagcgactac

SEQ ID NO: 45296 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctacaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctcttggtcatagcccacgagtgcggccaccacgccttcagcgactac

SEQ ID NO: 45297 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccctcaagaaagcaatcccacctcactgcttcaaacgctccatccctcgctccttctcctacctcctcttcgacatcctcgtctcctcctccctctaccacctctccacagcctacttccctctcctccccccccctctctcctacttcgcctggcctctctactgggcctgccagggctgcgtcctaaccggcgtctgggtcatagcccacgagtgcggccaccacgccttcagcgactac

SEQ ID NO: 45298 - DNA, 331 bp, Artificial
  Mutation in BnaC.FAD2.b introduced by TALE nuclease pair BnFAD2_T03
caggatccatgggtgcaggtggaagaacgcaagtctctactccctcaagctcccccgaaaccaaaaccctcaaacgcgtcccctgcgagacctcaagaaagcaatcccacctcactgcttcaaacgctccatccctcgctccttctcctacctcctcttcgacatcctcgtctccttctccctctaccacctctccacagcctacttccctctcctcccccaccctctcccttaccgcgcctggcccctctactgggcctgccaaggctgcttcctaacgggcctctgggtcatagcccacgaatgcggccaccacgccttcagcgactac

SEQ ID NO: 45299 - DNA, 429 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttccagcgcctgcttgccaccattattgctggcgatggccaccacctgctggggggtcaagccgtgggcctggcacagcaccggcaacagccggagacctcaagaaagcaatcccacctcactgcttcaaacgctccatcccacgctccttctcctcttcgacatcatcacctcctcctcggctcctccctctaccacctctccacagcctacttccctcgcccttacctcgcctgacccctctactgggcctgccaagggtgcgtcctaaccggcgtctgggtcatagcccacgagtgcggccaccacgccttcagcgactac

SEQ ID NO: 45300 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45301 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45302 - DNA, 372 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccacccttcactctcagcggctgttgccggtgctgtgccaggcccccgctcaatcccacctcactgcttcaaacgctccatccctcgctccttctcctacctcctcttcgacatcctcgtctcctcctccctccaccacctctccacagcctacttccctctccgccctcaccctctctcctacttcgcctggcctctctactgggcctgccaagggtgcgtcctaaccggcgtctgggtcatagcccacgagtgcggccaccacgccttcagcgactac

SEQ ID NO: 45303 - DNA, 349 bp, Artificial
  Mutation in BnaC.FAD2.b introduced by TALE nuclease pair BnFAD2_T03
caggatccatgggtgcaggtggaagaatacaagtctctcctccctccagctcccccggaaccaacaccctcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45304 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtcccctgcgagacaccgcccttcactgtaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggcggcgtcctaacgggcctctgggtcatagcccacgagtgcggccaccacgccttcagcgactac

SEQ ID NO: 45305 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctatcccttacctcgcctggcccctctactgggcctgccaaggctgcgtcctaacgggcctctgggtcatcgcccacgaatgcggccaccacgccttcagcgactac

SEQ ID NO: 45306 - DNA, 409 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgactacggcgtgatcgtggacaccacgagcatcacaaaaatcgacgcccaagtcagaggtggcgaaacccggagacctcaagaaagcaatcccacctcactgcttcaaacgctccatcccaccctccttctcctcttcgacatcatcatctcctcctcggctcctccccctcccacctctccccagcctacttccctctcccttccctcgcctggcccctctactgggcctgccaaggctgcgtcctaacgggcctctgggtcatagcccacgagtgcggccaccacgccttcagcgactac

SEQ ID NO: 45307 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctaccaaggctgcgtcctaaccggcgtctgggtcatagcccacgagtgcggccaccacgccttcagcgactac

SEQ ID NO: 45308 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacataatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45309 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatccctcgctccttctcctacctcctctccgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45310 - DNA, 421 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaaagactgggcctttagttttatctgttgtttgtcggtgaacgctctcctgagtaggacaaatccgcccgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 45311 - DNA, 336 bp, Artificial
  Mutation in BnaC.FAD2.b introduced by TALE nuclease pair BnFAD2_T03
caggatccatgggtgcaggttgaagaatgcaagtctctcctccctcaagctcccccgaaaccaaaaccctcaaacgcgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcggcctaacgggcctctgggtcatagcccacgagtgcggccaccacgccttcagcgactac

SEQ ID NO: 45312 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 45313 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgacctcaagaaagcaatcccacctcactgcttcaaacgctccatcccacgccccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45314 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgaaacaccaccattcactctagacctcaagaaagcaatcccacctcactgcttcaaacgctccatccctcgctccttctcctacctcctcttcgacatcctcgtctcctcctccctctaccacctctccacaccctacttccctctcctcccccaccctctcccttacctcccctggcccctctactgggcctgccaagggtgcgtcctaacgggcctctgggtcatagcccacgagtgcggccaccacgccttcagcgactac

SEQ ID NO: 45315 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagcaagcaatcccacctcactgcttcaaacactccatccctcgctccttctcctacctcctcttcgtcatcctcgtctcctcctccctctaccacctctccacagcctacttccctcccctcccccaccctctcccttacctcgcctggcccctctactgggcctgccaaggctgcgtcctaacgggcctctgggtaatcgcccacgaatgcggccaccacgccttcagcgactac

SEQ ID NO: 45316 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 45317 - DNA, 438 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgactgttgccggtgctgtgccaggcccacggcttgaccccccagcaggtggtggccatcgccagcaatggcggtggcaagcaggcgctggagacggacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45318 - DNA, 438 bp, Artificial
  Mutation in BnaC.FAD2.b introduced by TALE nuclease pair BnFAD2_T03
caggatccatgggtgcaagtggaataatgcaagtctctcctccctacagctcccccgaaaccaaaaccctcaaacgcgtcccctgcgagacaccacccttcactctcggcaacagccgctggaccgttgctgtgccaggcccacggcttgaccccccagcaggtggtggccatcgccagcaatggcggtggcggagacctcaagaaagcaatcccacctcactgcttcaaacgctccatccctcgctccttctcctacctcctctccgccatcctcgtctccccctccctctaccacccctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45319 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactccagacctcaagaaagcaatcccacctcactgcttcaaacgctcgatccctcgctctttctcctacctcatctgggacatcatcatagcctcctcggctcctccctctaccacctctccacagcctacttccctctcccttacctcgcctgacccctctactgggccggccaaggctgcgtcctaacgggcctctgggtcatagcccacgagtgcggccaccacgccttcagcgactac

SEQ ID NO: 45320 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgatccctctactgggcctgccaaggctgcgtcctaacgggcctctgggtcatagcccacgagtgcggccaccacgccttcagcgactac

SEQ ID NO: 45321 - DNA, 274 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaacgggcctctgggtcatagcccacgagtgcggccaccacgccttcagcgactac

SEQ ID NO: 45322 - DNA, 349 bp, Artificial
  Mutation in BnaC.FAD2.b introduced by TALE nuclease pair BnFAD2_T03
caggacccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgtgtcctaacgggcctctgggtcatcgcccacgaatgcggccaccacgccttcagcgactac

SEQ ID NO: 45323 - DNA, 300 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgtgcctctgggtcatcgcccacgaatgcggccaccacgccttcagcgactac

SEQ ID NO: 45324 - DNA, 328 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45325 - DNA, 300 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 45326 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 45327 - DNA, 362 bp, Artificial
  Mutation in BnaC.FAD2.b introduced by TALE nuclease pair BnFAD2_T03
caggatccatgggtgcaggtggaagaatgcaagtctctactccctccagctcccccggaaccaacacactcaaccgcgtcccctgcgagacaccaccattcactcaatggcggtggcaagcaggcgctggagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45328 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagccaccaccattcactcgagaccacaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcggcctaacgggcctctgggtcatctcccacgaatgcggccaccacgccatcaacgactac

SEQ ID NO: 45329 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 45330 - DNA, 336 bp, Artificial
  Mutation in BnaC.FAD2.b introduced by TALE nuclease pair BnFAD2_T03
caggatccatgggtgcaggttgaagaatgcaagtgtctcctccctccaaaaagtctgaaaccgacaacatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45331 - DNA, 415 bp, Artificial
  Mutation in BnaC.FAD2.b introduced by TALE nuclease pair BnFAD2_T03
caggatccatgagtgcaggtggaagaatgcaagtctctcctccctccagctcccccgaaaccaaaaccctcaaacgcgtcccctgcgagacaccacccttcactctagagcggatttgtcctactcaggagagcgttcaccgacaaacaacagataaaacgaaaggctcagagacctcaagaaagcaatcccacctcactgcttcaaacgctccatccctcgctccttctcctacctcctcttcgacatcctcgtctcctcctccctctaccccctctccccagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 45332 - DNA, 265 bp, Artificial
  Mutation in BnaC.FAD2.b introduced by TALE nuclease pair BnFAD2_T03
caggatccatgggtgcaggtggaagaatgcaagtctcgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 45333 - DNA, 369 bp, Artificial
  Mutation in BnaC.FAD2.b introduced by TALE nuclease pair BnFAD2_T03
caggatccatgggtgcaggcggaagaatgcaagtctctcctcactccagctcccccggacccaacaccctcaaacgcgtcccctgcgagacaccaccattcactccgtccagcggctgttgccggtgttgtgcctggcggagacctcaagaaagcaatcccaccgcactgtttcaaacgctcgatccctcgctctttctcctacctcatctgggacatcatcatagcctcctgcttctaccacctctccgcagcctacgtcccgctcccttacctcgcctgacccctctactgggcctgccaaggctgcgtcctaacgggcctctgggtcatagcccacgagtgcggccaccacgccttcagcgactac

SEQ ID NO: 45334 - DNA, 394 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttggccaccacctgctccggggtcaagctggaggggtacaccttccaccactcgttgggagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45335 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45336 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagaccccaacaaagcaatcccacctcactgcttcaaacgctccatcccaccctccttctcctcttcgacatcaccatctcctcctcggctcctccctctaccacctctccacagcctacttccctctcccttaccccgcctgacccctctactgggcctgccaaggctgcgtcctaacgggcctctgggtcaaagcccacgagtgcggccaccacgccttcagcgactac

SEQ ID NO: 45337 - DNA, 303 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatacacaaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45338 - DNA, 349 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactaagacctaaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45339 - DNA, 348 bp, Artificial
  Mutation in BnaC.FAD2.b introduced by TALE nuclease pair BnFAD2_T03
caggatccatgggtgcaggtggaagaatgcaagtctctcctcactccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacatatgcgtccaccacgccttcagcgactac

SEQ ID NO: 45340 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaacactcaaacgcgtcccctgcgagacaccacccttcactctgacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45341 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatcccacgctccttctcctcttcgacatcatcatctcctcctcggctcctccctctaccacctcaccacagcctacttccctctcccttacctcgcctgacccctctactgggcctaccaaggctgcgtcctaacgggcctctggttcatagcccacgagtgcgtccaccacgccttgagcgactac

SEQ ID NO: 45342 - DNA, 343 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccaccattcactctcggaaagcaatcccacctcactgcttcaaacgctccatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45343 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45344 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45345 - DNA, 435 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggtccagcggctgttgccggtgctgtgccaggcccacggcttgaccccccagcaggtggtggccatcgccagcaatggcggtggcaagcaggcgctggagagacctcaagaaagcaatcccccctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45346 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 45347 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctgacgggcctctgggtcatagcccacgagtgcggccaccacgccttcagcgactac

SEQ ID NO: 45348 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccttccaaggctgcgtcctaaccggcgtcttggtcatagcccacgagtgcggccaccacgccttcagcgactac

SEQ ID NO: 45349 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactctagacctcaagaaagcaatcccacctcactgcttcacacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45350 - DNA, 476 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggtggccatcgccagcaataatggtggcaagcaggcgctggagacggtccagcggctgttgccggtgctgtgcccggcccacggcttgaccccccagcaggtggtggccatcgccagagacctcaagaaagcaatcccacctcactgctacaaacgctccatccctcgctcctcctcctgccacctcttcgacagcatcatcacctccgcggctcctccctctaccacctctccacagcctacttccctctcctcccccaccctcgcccttacctcgcctggcccctctactgggcctgccaaggctgcgtcctaacgggcctctgggtcatcgcccacgaatgcggccaccacgccttcagcgactac

SEQ ID NO: 45351 - DNA, 370 bp, Artificial
  Mutation in BnaC.FAD2.b introduced by TALE nuclease pair BnFAD2_T03
caggatccatgggtgcaggtggaagaatgcaagtctcccctccattcagctcccccgaaaccaaaaccctcaaacgcgtcccctgcgagacaccaccattcactctcggcggataaccgtattaccgcctttgagtgagctgacctcaagaaagcaatcccacctcactgcttcaaacgctccatcccacgctccttctcctcttcgacatcatcatctcctcctcggctcctccctctaccacctctccacagcctcctcccctctcccttccctcgcctgacccctctactgggcctgccaaggctgcgtcctaacgggcctctgggtcatagcccacgagtgcggccaccacgccttcagcgactac

SEQ ID NO: 45352 - DNA, 334 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttaactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45353 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 45354 - DNA, 336 bp, Artificial
  Mutation in BnaC.FAD2.b introduced by TALE nuclease pair BnFAD2_T03
caggatccatgggtgcaggtggaataatgcaagtctctcctcactccagctcccccggaaccaacaccctcaaacgcgtcccctgcgagacaccacccttcactctagacctcaagaaagcaatcccacctcactgcttcaaacgctccatcccacgctccttctcctcttctacatcatcatctcctcctcggctcctccctctaccacctctccacaccctacttccctctcccttacctcgcctgacccctctactgggcctgccaaggctgcgtcctaacgggcctctgggtcatagcccacgagtgcggccaccacgccttcagcgactac

SEQ ID NO: 45355 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaccgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45356 - DNA, 398 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtacttcaagtgtctcctccctccaaaaagtctgaaaccgacaacatacgcaaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 45357 - DNA, 449 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctattgctggcgatggccaccacctgctggggggtcaagccgtgggcctggcacagcaccggcaaaggccatccgtcaggatggccttctgcttagtttgatgcctggcagtttatggcggagaactcaagaaagcaatcccacctcactgcttcaaacgctccatcccacgctccttctcctcttcgacatcctcgtctcctcctccctctaccacctctccacagcctacttccctctcccttaccgcgcctggcccctctactgggcctgccaaggctgcgtcctaacgggcctctgggtcatcgcccacgaatgcggccaccacgccttcagcgactac

SEQ ID NO: 45358 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45359 - DNA, 336 bp, Artificial
  Mutation in BnaC.FAD2.b introduced by TALE nuclease pair BnFAD2_T03
caggatccatgggtgcaggtggaagaatgcaagtctcacctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttaactcgcctgacccctctcctgggcctgccaaggctgcgtcctaacgggcctctgggtcatagcccacgagtgcggccaccacgccttcagcgactac

SEQ ID NO: 45360 - DNA, 317 bp, Artificial
  Mutation in BnaC.FAD2.b introduced by TALE nuclease pair BnFAD2_T03
caggatccatgggtgcaggtggaagaatgcaagtctctccaccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45361 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcaagaaagcaatcccacctcactgcttcaaacgctccatccctcgctccttctcctacctcctcttcgacatcatcatctcctcctcggctcctccctctaccacctctccacagcctacttccctctcccttaccgcgcctaacccctctactgggcctgccaaggctgcgtcctaacgggcctctgggtcatagcccacgagtgcggccaccgcgccttcagcgactac

SEQ ID NO: 45362 - DNA, 381 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggccttctgcttagtttgatgcctggcagtttatggcgggcataagacctcaagaaagcaattccacctcactgcttcaaacgctccatcccacgctccttctccccttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45363 - DNA, 338 bp, Artificial
  Mutation in BnaC.FAD2.b introduced by TALE nuclease pair BnFAD2_T03
caggatccatgggttcaggtggaagaatgcaagtctctcctccctccagctcccccgaaaccaaaaccctcaaacgcgtcccctgcgagacaccacccttcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45364 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaagcctgcgtcctaacgggcctctgggtcatcgcccacgaatgcggccaccacgccttcagcgactac

SEQ ID NO: 45365 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcgagacctcaagaaagcaatcccacctcactgcttcaaacgctccatcccacgctccttctcctcttcgacataatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45366 - DNA, 393 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcaccggcaacagccgctggaccgtctccagcgcctgcttgccaccagagacctcaagaaagcaatcccacctcactgcttcaaacgctccatcccacgctccttctcctcttcgacatcctcgtctcctcctccctctaccacctctacacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 45367 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccacctcaaggaagcaatcccacctcactgcttcaaacgctccatcccacgctccttctcctcttcgacatcatcatctcctcctcggctcctccctctaccacctctccacagcctacttccctcccccttacctcgcctgacccctctacggggcctgccaaggctgcgtcctcccgggcctctgggtcatagcccacgagtgcggccaccccgccttcagcgactac

SEQ ID NO: 45368 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggtcaccacgccttcagcgactac

SEQ ID NO: 45369 - DNA, 379 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggccacgatggcggcaacagccgctggagggagaactcaagaaagcaatcccaccgcactgtttcaaacgctcgatccctcgctctttctcctacctcctcttcgacatcctcgtctcctcctccctctaccacctctccacagcctacttccccctcccccccctccctctcccttacctcgcctggcccctctactgggcctgccaaggctgcgtcctaacgggcctctgggtcatcgcccacgaatgcggccaccacgccttcagcgactac

SEQ ID NO: 45370 - DNA, 331 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 45371 - DNA, 328 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45372 - DNA, 335 bp, Artificial
  Mutation in BnaC.FAD2.b introduced by TALE nuclease pair BnFAD2_T03
caggatccatgggtgcaggtggaagaatgcaagtctctcctccatacaggaaccccgaaaccaaaaccatcaaacgcgtaccctgcgagacaccacccttcactcagacataaagaaagcaatcaaacctaactgattgatacgaacaatccctcgctccttctcttcttcgacataatcatctcctcatcggctcctccctctacaacctctccacagcctatttccctctcccctacctcgcctggcccctctactgggcctgccaaggctgcgtcctaaccggcctctgggtcatagcccacgagtgcggccaccacgccttcagcgactac

SEQ ID NO: 45373 - DNA, 337 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccaccattcactctaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45374 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtccccacgcgtcccagcaatggcggtggcaagcaggcgctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45375 - DNA, 349 bp, Artificial
  Mutation in BnaC.FAD2.b introduced by TALE nuclease pair BnFAD2_T03
caggatccatgggtgcaggtggaagaatgcaagtctctaatccctcaagctcctccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45376 - DNA, 384 bp, Artificial
  Mutation in BnaC.FAD2.b introduced by TALE nuclease pair BnFAD2_T03
caggatccatgggtgcaggtggaagaatgcaagtctctcctccctccagctccccggaaccaacaccctcaaacgcgtcccctgcgagacaccaccattcactctcggcccacggcttgaccccccagcaggtggtggccatcgccagcaatggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 45377 - DNA, 448 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagcgcctgcttgccgccatcgtggctggcgatggccaccacctgctccggggtcaagccgtgggcctggcacagcaccggcaacagccgctggacggagacctcaagaaagcaatcccacctcactgcttcaaacgctccatccctcgctccttctcctaccgccgctacgacagcctcgtctcctcctccctctaccacccctccacagcctacttccctcgccgcccccaccctctcccttacctcgcctggcccctctactgggcctgccaaggctgcgtcctaacgggcctctgggtcatcgcccacgaatgcggccaccacgccttcagcgactac

SEQ ID NO: 45378 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctaacccctctactgggcctgccaaggctgcgtcctaacgggcctctgggtcatagcccacgagtgcggccaccacgccttcagcgactac

SEQ ID NO: 45379 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45380 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 45381 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgtagagaaagcaatcccacctcactgcttcaaacgctccatccctcgctccttctcctacctcctcttcgacatcctcgtctcctcctccctctaccacctctccacagcctacttccctctcctcccccaccctctcccctacttcgcctggcctctctactgggcctgccaagggtgcgtcctaaccggcgtctgggtcatagcccacgagtgcggccaccacgccttcagcgactac

SEQ ID NO: 45382 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctcctgggcctgccaaggctgcgtcctaacgggcctctgggtcatagcccacgagtgcggccaccacgccttcagcgactac

SEQ ID NO: 45383 - DNA, 439 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgtccagcggctgttgccggtgctgtgccaggcccacggcttgcccccggagcaggtggtggccatcgccagcaatattggtggcaagcaggcgctggcacaaagacctcaagaaagcaatcccacctcactgcttcaaacgctccaccccacgctccttcgcctcttcgacaccatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45384 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgacctcaagaaagcaatcccacctcactgcttcaaacgctccatccctccctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45385 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagccttcttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45386 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatccctcctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45387 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccaccctccttctcccctccgacatcatcatctcctcctcgcctcctccctctaccacctctccacagcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 45388 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 45389 - DNA, 346 bp, Artificial
  Mutation in BnaC.FAD2.b introduced by TALE nuclease pair BnFAD2_T03
caggatccatgggtgcaggtggaagaatgcaagtctctcctccatcgagctcccccgaaaccaaaaccctcaaacgcgtcccctgcgagacaccacccttcactacaccaagaaagcaatcccacctcactgcttcaaacgctccacccctcgctcctcctcctacctcctcttcgacatcctcgtctcctcctccctctaccgcctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 45390 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgccccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45391 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45392 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtccgaacgggcctctgggtcatagcccacgagtgcggccaccacgccttcagcgactac

SEQ ID NO: 45393 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgcgacaccacccttcactagaccacaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcggcctaacgggcctctgggtcatagcccacgagtgcggccaccacgccttcagcgactac

SEQ ID NO: 45394 - DNA, 382 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctggcgctggccaccaccattcactcggggggtcaagccgtgggcctggcacagcaccggcaacagccgcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45395 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccccctcacttcttcaaacgctccatccctcgctccttctcctacctcctcttcgacatcctcttctcctcctccctctaccacctctccacagcctacttccctctcctcccccaccctctcccttacctcgcctgccccctctactgggcctgccaaggctgcgtcctaacgggcctctgggtcatcgcccacgaatgcggccaccacgccttcagcgactac

SEQ ID NO: 45396 - DNA, 301 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaagaaagcaatcccacctcactgcttcaaacgctccatccctcgctccttctcctcttcgacatcatcatctcctcctcggctcctccctctaccacctctccacagcctacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 45397 - DNA, 335 bp, Artificial
  Mutation in BnaC.FAD2.b introduced by TALE nuclease pair BnFAD2_T03
caggatccatgggtgcaggtggaagaatgcaagtatctcctccctccaactcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45398 - DNA, 336 bp, Artificial
  Mutation in BnaC.FAD2.b introduced by TALE nuclease pair BnFAD2_T03
cagggtccatgggtgcaggtggaagaatgcaagtctctcctccctccagctcccccgaaaccaaaaccctcaaacgcgtcccctgcgagacaccaccattcacatgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45399 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45400 - DNA, 323 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 45401 - DNA, 349 bp, Artificial
  Mutation in BnaC.FAD2.b introduced by TALE nuclease pair BnFAD2_T03
caggatccatgggtgcagctgaaagaatgcaagtctccaatacctaaagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctccgcccccaccctctcccttacctcgcctggcccctctactgggcctgccaaggctgcgtcctaaccggcggctgggtcatagcccacgagtgcggccaccacgccttcagcgactac

SEQ ID NO: 45402 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccctgaaccaacaccctcaaacgcgtcccctgcgagacacccccattcactctcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45403 - DNA, 344 bp, Artificial
  Mutation in BnaC.FAD2.b introduced by TALE nuclease pair BnFAD2_T03
caggatccatgggtgcaggtggaagaatgcaagtctatcctccctacagctcccccgaaaccaaaaccctcaaacgcgtcccctgcgagacaccacccttcactctgagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45404 - DNA, 426 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctccccccagcaggtggtggccatcgccagcaatggcggtggcaagcaggcgctggagacggtccagcggctgttgccggtgctgtgccaggacacctcaagaaagcaatcccacctcactccttcaaactctccaccccacgctccttctcctcttcgacacaatcacctcctcctcggctcctccccctcccacctccccacagcctacttccctctcccttacctcgcctgacccctctactgggcctgccaaggctgcgtcctaacgggcctctgggtcatagcccacgagtgcggccaccacgccttcagcgactac

SEQ ID NO: 45405 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 45406 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45407 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45408 - DNA, 384 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcggggtcaagccgtgggcctggcacagcaccggcaacaggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45409 - DNA, 339 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatcggagacctcaagaaagcaatcccaccgcactgtttcaaacgctcgatccctcgctctttctcctacctcatctgggacatcatcatagcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 45410 - DNA, 307 bp, Artificial
  Mutation in BnaC.FAD2.b introduced by TALE nuclease pair BnFAD2_T03
caggatccatgggtgcaggtggaagaatgcaagtctctcctccctccagctcccccggaaccaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45411 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctttagcgactac

SEQ ID NO: 45412 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45413 - DNA, 349 bp, Artificial
  Mutation in BnaC.FAD2.b introduced by TALE nuclease pair BnFAD2_T03
caggatccatgggtgcaggtgaaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgcgcctggcccctctactgggcctgccagggctgcgtcctaacgggcctctgggtcatagcccacgagtgcggccaccacgccttcagcgactac

SEQ ID NO: 45414 - DNA, 414 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaggccgccattgctggcgatggccaccacctgctgaggggtcaagccgggggcctggcacagcaccggcaacagccgagacctcaagaaagcaatcccacctcactgcttcaaacgctccatcccacgctccttctcctcttcgacatcatcatctcctcctcggctcctccctctaccacctccccacagcctacttccctctcccttccctcgcctgacccctctactgggcctgccaaggctgcgtcctaacgggcctctgggtcatagcccacgagtgcggccaccacgccttcagcgactac

SEQ ID NO: 45415 - DNA, 319 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45416 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacagacctcaagaaagcaatcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 45417 - DNA, 333 bp, Artificial
  Mutation in BnaC.FAD2.b introduced by TALE nuclease pair BnFAD2_T03
caggatccattggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggtcaccacgccttcagcgactac
